US010119145B2

(12) United States Patent
Gramajo et al.

(10) Patent No.: US 10,119,145 B2
(45) Date of Patent: Nov. 6, 2018

(54) ENGINEERED ORGANISMS FOR PRODUCTION OF NOVEL LIPIDS

(71) Applicants: Consejo Nacional de Investigaciones Cientificas y Tecnicas (CONICET), Ciudad Autonoma de Buenos Aires (AR); Inis Biotech LLC, Milford, DE (US)

(72) Inventors: Hugo Gramajo, Sante Fe (AR); Ana Arabolaza, Sante Fe (AR); Santiago Comba, Sante Fe (AR); Simón Menendez-Bravo, Sante Fe (AR); Héctor Álvarez, Chubut (AR)

(73) Assignee: CONSEJO NACIONAL DE INVESTIGACIONES CIENTIFICAS Y TECNICAS (CONICET), Buenos Aires (AR)

( * ) Notice: Subject to any disclaimer, the term of this patent is extended or adjusted under 35 U.S.C. 154(b) by 382 days.

(21) Appl. No.: 14/777,345

(22) PCT Filed: Mar. 14, 2014

(86) PCT No.: PCT/US2014/028883
§ 371 (c)(1),
(2) Date: Sep. 15, 2015

(87) PCT Pub. No.: WO2014/144461
PCT Pub. Date: Sep. 18, 2014

(65) Prior Publication Data
US 2016/0053271 A1 Feb. 25, 2016

Related U.S. Application Data

(60) Provisional application No. 61/798,943, filed on Mar. 15, 2013.

(51) Int. Cl.
*C12N 15/52* (2006.01)
*C12N 9/00* (2006.01)
*C12P 7/64* (2006.01)

(52) U.S. Cl.
CPC ............... *C12N 15/52* (2013.01); *C12N 9/93* (2013.01); *C12P 7/6409* (2013.01); *C12P 7/6436* (2013.01); *Y02E 50/343* (2013.01)

(58) Field of Classification Search
None
See application file for complete search history.

(56) References Cited

U.S. PATENT DOCUMENTS

| | | |
|---|---|---|
| 7,011,959 B1 | 3/2006 | Santi et al. |
| 7,291,486 B2 | 11/2007 | Santi et al. |
| 8,071,358 B1 | 12/2011 | Dundon et al. |
| 2010/0105963 A1 | 4/2010 | Hu |
| 2010/0242345 A1 | 9/2010 | Keasling et al. |
| 2010/0251601 A1 | 10/2010 | Hu et al. |
| 2010/0298612 A1 | 11/2010 | Behrouzian et al. |
| 2011/0166370 A1 | 7/2011 | Saunders et al. |

FOREIGN PATENT DOCUMENTS

| | | |
|---|---|---|
| AU | 2003253949 A1 | 2/2004 |
| EP | 2297286 A2 | 3/2011 |
| WO | WO-0102555 A1 | 1/2001 |
| WO | WO-2007136762 A2 | 11/2007 |
| WO | WO-2008151149 A2 | 12/2008 |
| WO | WO-2010062480 A2 | 6/2010 |
| WO | WO-2011088088 A1 | 7/2011 |

OTHER PUBLICATIONS

Akhtar, M.K., et al., "Carboxylic Acid Reductase Is a Versatile Enzyme for the Conversion of Fatty Acids Into Fuels and Chemical Commodities," Proceedings of the National Academy of Sciences of the USA 110(1):87-92, National Academy of Sciences, United States (2013).

Azad, A.K., et al., "Targeted Replacement of the Mycocerosic Acid Synthase Gene in Mycobacterium Bovis Bcg Produces a Mutant That Lacks Mycocides," Proceedings of the National Academy of Sciences of the USA 93(10):4787-4792, National Academy of Sciences, United States (1996).

Baba, T., et al., "Construction of *Escherichia coli* K-12 in-frame, Single-gene Knockout Mutants: the Keio Collection," Molecular Systems Biology 2:1, 11 pages, Wiley Blackwell, England (2006).

Bligh, E.G. and Dyer, W.J., "A Rapid Method of Total Lipid Extraction and Purification," Canadian Journal of Biochemistry and Physiology 37(8):911-917, National Research Council, Canada (1959).

Bloch, K. and Vance, D., "Control Mechanisms in the Synthesis of Saturated Fatty Acids," Annual Review of Biochemistry 46:263-298, Annual Reviews, Inc., United States (1977).

Campbell, C.J. and Laherrere, J.H., "The End of Cheap Oil," Scientific American 78-83, Nature publishing group, United States (1998).

(Continued)

*Primary Examiner* — Suzanne M Noakes
*Assistant Examiner* — Jae W Lee
(74) *Attorney, Agent, or Firm* — Sterne, Kessler, Goldstein & Fox P.L.L.C.

(57) ABSTRACT

The present disclosure provides engineered microorganisms, engineered biosynthetic pathways, methods of producing lipid compounds using genetically engineered microorganisms, and the products synthesized by those organisms. In particular, the disclosure provides genetically engineered microorganisms for the production of multi-methyl branched fatty acids (MMBFAs) and MMBFA esters (wax esters) derived from these fatty acids. In addition, the disclosure provides methods for producing acylglycerols with one of more of their acyl substituents being an MMBFA, and methods for producing alcohols derived from MMBFAs (fatty alcohols).

15 Claims, 10 Drawing Sheets
Specification includes a Sequence Listing.

(56) References Cited

OTHER PUBLICATIONS

Cantu, D.C., et al., "Thioesterases: a New Perspective Based on Their Primary and Tertiary Structures," Protein Science 19(7):1281-1295, Wiley-Blackwell, United States (2010).
Cho, H. and Cronan, J.E.Jr., "Defective Export of a Periplasmic Enzyme Disrupts Regulation of Fatty Acid Synthesis," The Journal of Biological Chemistry 270(9):4216-4219, American Society for Biochemistry and Molecular Biology, United States (1995).
Choi, Y.J., and Lee, S.Y., "Microbial Production of Short-chain Alkanes," Nature 502:571-576, Nature Publishing Group, United States (2013).
Cropp, T.A., et al., "Fatty-acid Biosynthesis in a Branched-chain Alpha-keto Acid Dehydrogenase Mutant of Streptomyces Avermitilis," Canadian Journal of Microbiology 46(6):506-514, Canadian Science Publishing, Canada (2000).
Datsenko, K.A. and Wanner, B.L., "One-step Inactivation of Chromosomal Genes in *Escherichia coli* K-12 Using PCR Products," Proceedings of the National Academy of Sciences of USA 97(12):6640-6645, National Academy of Sciences, United States (2000).
Dayem, L.C., et al., "Metabolic Engineering of a Methylmalonyl-CoA Mutase-epimerase Pathway for Complex Polyketide Biosynthesis in *Escherichia coli*," Biochemistry 41(16):5193-5201, American Chemical Society, United States (2002).
Diacovich, L., et al., "Kinetic and Structural Analysis of a New Group of Acyl-CoA Carboxylases Found in Streptomyces Coelicolor A3(2)," The Journal of Biological Chemistry 277(34):31228-31236, American Society for Biochemistry and Molecular Biology, United States (2002).
Gago, G., et al., "Biochemical and Structural Characterization of an Essential Acyl Coenzyme a Carboxylase From Mycobacterium Tuberculosis," Journal of Bacteriology 188(2):477-486, American Society for Microbiology, United States (2006).
Gokhale, R.S., et al., "Versatile Polyketide Enzymatic Machinery for the Biosynthesis of Complex Mycobacterial Lipids," Natural Product Reports 24(2):267-277, Royal Society of Chemistry, England (2007).
Gokhale, R.S., et al., "Versatility of Polyketide Synthases in Generating Metabolic Diversity," Current Opinion in Structural Biology 17(6):736-743, Elsevier Science, England (2007).
Guzman, L.M., et al., "Tight Regulation, Modulation, and High-level Expression by Vectors Containing the Arabinose PBAD Promoter," Journal of Bacteriology 177(14):4121-4130, American Society for Microbiology, United States (1995).
Haldimann, A. and Wanner, B.L., "Conditional-replication, Integration, Excision, and Retrieval Plasmid-host Systems for Gene Structure-function Studies of Bacteria," Journal of Bacteriology 183(21):6384-6393, American Society for Microbiology, United States (2001).
Hertweck, C., "The Biosynthetic Logic of Polyketide Diversity," Angewandte Chemie 48(26):4688-4716, Wiley-VCH, Germany (2009).
Hofvander, P., et al., "A Prokaryotic Acyl-CoA Reductase Performing Reduction of Fatty Acyl-CoA to Fatty Alcohol," FEBS Letters 585(22):3538-3543, Elsevier, B.V., Netherlands (2011).
Horswill, A.R., and Escalante-Semerena, J.C., "*Salmonella typhimurium* LT2 Catabolizes Propionate via the 2-methylcitric Acid Cycle," Journal of Bacteriology 181(8):5615-5623, American Society for Microbiology, United States (1999).
Horswill, A.R., and Escalante-Semerena, J.C., "The prpE Gene of *Salmonella typhimurium* LT2 Encodes Propionyl-CoA Synthetase," Microbiology 145:1381-1388, Microbiology Society, England (1999).
International Search Report and Written Opinion for International Application No. PCT/US2014/028883, Commissioner for Patents, United States, dated Jan. 29, 2015, 14 pages.
Jacobsen, J.R., et al., "Precursor-directed Biosynthesis of Erythromycin Analogs by an Engineered Polyketide Synthase," Science 277(5324):367-369, American Association for the Advancement of Science, United States (1997).
Kato, Y., et al., "Functional Expression of Genes Involved in the Biosynthesis of the Novel Polyketide Chain Extension Unit, Methoxymalonyl-acyl Carrier Protein, and Engineered Biosynthesis of 2-desmethy1-2-methoxy-6-deoxyerythronolide B," Journal of the American Chemical Society 124(19):5268-5269, American Chemical Society, United States (2002).
Kodali, D.R., "High Performance Ester Lubricants From Natural Oils," Industrial Lubrication and Tribology 54(4):165-170, MCB UP Limited, England (2002).
Lambalot, R.H., et al., "A New Enzyme Superfamily—the Phosphopantetheinyl Transferases," Chemistry & Biology 3(11):923-936, Current Biology Limited, United States (1996).
Liu, Q. et al., "Acyl-CoA:diacylglycerol Acyltransferase: Molecular Biology, Biochemistry and Biotechnology," Progress in Lipid Research 51(4):350-377, Pergamon, England (2012).
Maleque, M.A., et al., "Vegetable-based Biodegradable Lubricating Oil Additives," Industrial Lubrication and Tribology 55(3):137-143, MCB UP Limited, England, (2003).
Mathur, M. and Kolattukudy, P.E., "Molecular Cloning and Sequencing of the Gene for Mycocerosic Acid Synthase, a Novel Fatty Acid Elongating Multifunctional Enzyme, From Mycobacterium Tuberculosis Var. Bovis Bacillus Calmette-guerin," The Journal of Biological Chemistry 267(2):19388-19395, American Society for Biochemistry and Molecular Biology, United States (1992).
Menzella, H.G., et al., "Combinatorial Polyketide Biosynthesis by De Novo Design and Rearrangement of Modular Polyketide Synthase Genes," Nature Biotechnology 23(9):1171-1176, Nature America Publishing, United States (2005).
Mo, S., et al., "Biosynthesis of the Allylmalonyl-coA Extender Unit for the FK506 Polyketide Synthase Proceeds Through a Dedicated Polyketide Synthase and Facilitates the Mutasynthesis of Analogues," Journal of the American Chemical Society 133(4):976-985, American Chemical Society, United States (2011).
Murli, S., et al., "Metabolic Engineering of *Escherichia coli* for Improved 6-deoxyerythronolide B Production," Journal of Industrial Microbiology & Biotechnology 30(8):500-509, Springer, Germany (2003).
Nakamura, C.E. and Whited, G.M., "Metabolic Engineering for the Microbial Production of 1,3-propanediol," Current Opinion in Biotechnology 14(5):454-459, Elsevier, England (2003).
Onwueme, K.C., et al., "Mycobacterial Polyketide-associated Proteins Are Acyltransferases: Proof of Principle With Mycobacterium Tuberculosis PapA5," Proceedings of the National Academy of Sciences of the USA 101(13):4608-4613, National Academy of Sciences, United States (2004).
Park, J.H. and Lee, S.Y., "Towards Systems Metabolic Engineering of Microorganisms for Amino Acid Production," Current Opinion in Biotechnology 19(5):454-460, Elsevier, London (2008).
Peralta-Yahya, P.P., et al., "Microbial Engineering for the Production of Advanced Biofuels," Nature 488:320-328, (2012).
Petti, C.A., et al., "Detection and Identification of Microorganisms by Gene Amplification and Sequencing," Clinical Infectious Diseases 44:1108-1114, (2007).
Pfeifer, B.A., et al., "Biosynthesis of Complex Polyketides in a Metabolically Engineered Strain of *E. coli*," Science 291(5509):1790-1792, American Association for the Advancement of Science, United States (2001).
Pfeifer, B.A., et al., "Biosynthesis of Yersiniabactin, a Complex Polyketide-nonribosomal Peptide, Using *Escherichia coli* as a Heterologous Host," Applied and Environmental Microbiology 69(11):6698-6702, American Society for Microbiology, United States (2003).
Reeves, C.D., et al., "Alteration of the Substrate Specificity of a Modular Polyketide Synthase Acyltransferase Domain Through Site-specific Mutations," Biochemistry 40(51):15464-15470, American Chemical Society, United States (2001).
Reeves, C.D., et al., "Production of Hybrid 16-membered Macrolides by Expressing Combinations of Polyketide Synthase Genes in Engineered Streptomyces Fradiae Hosts," Chemistry & Biology 11(10):1465-1472, Elsevier, United States (2004).
Reiser, S. and Somerville, C., "Isolation of mutants of Acinetobacter calcoaceticus deficient in wax ester synthesis and complementation of one mutation with a gene encoding a fatty acyl coenzyme a reductase," Journal of Bacteriology 179(9):2969-2975, The American Society for Microbiology, United States (1997).

(56) References Cited

OTHER PUBLICATIONS

Rodriguez, E., et al., "Role of an essential acyl coenzyme a carboxylase in the primary and secondary metabolism of Streptomyces coelicolor A3(2)," Applied and Environmental Microbiology 67(9):4166-4176, American Society for Microbiology, United States (2001).

Schweizer, E. And Hofmann, J., "Microbial Type I Fatty Acid Synthases (FAS): Major Players in a Network of Cellular FAS Systems," Microbiology and Molecular Biology 68(3):501-517, American Society for Microbiology, United States (2004).

Smith, J.L. and Sherman, D.H., "An Enzyme Assembly Line," Science 321(5894):1304-1305, American Association for the Advancement of Science, United States (2008).

Stassi, D.L., et al., "Ethyl-substituted Erythromycin Derivatives Produced by Directed Metabolic Engineering," Proceedings of the National Academy of Sciences of USA 95(13):7305-7309, National Academy of Sciences, United States (1998).

Steinbuchel, A., "Non-biodegradable Biopolymers From Renewable Resources: Perspectives and Impacts," Current Opinion in Biotechnology 16(6):607-613, Elsevier, England (2005).

Studier, F.W., et al., "Use of T7 RNA Polymerase to Direct Expression of Cloned Genes," Methods in Enzymology 185:60-89, Academic Press., United States (1990).

Trivedi, O.A., et al., "Dissecting the Mechanism and Assembly of a Complex Virulence Mycobacterial Lipid," Molecular Cell 17(5):631-643, Elsevier, Inc., United States (2005).

Turchetto-Zolet, A.C., et al., "Evolutionary View of Acyl-coa Diacylglycerol Acyltransferase (DGAT), a Key Enzyme in Neutral Lipid Biosynthesis," BMC Evolutionary Biology 11:263, BioMed Central, England (2011).

Wagner, H., et al., "Lubricant Base Fluids Based on Renewable Raw Materials: Their Catalytic Manufacture and Modification," Applied Catalysis A: General 221(1-2):429-442, Elsevier Science B.V., The Netherlands (2001).

Waltermann, M. and Steinbuchel, A., "In Vitro Effects of Sterculic Acid on Lipid Biosynthesis in Rhodococcus Opacus Strain Pd630 and Isolation of Mutants Defective in Fatty Acid Desaturation," FEMS Microbiology Letters 190(1):45-50, Elsevier Science B.V., The Netherlands (2000).

Watanabe, K., et al, "Engineered Biosynthesis of an Ansamycin Polyketide Precursor in *Escherichia coli*," Proceedings of the National Academy of Sciences of the USA 100(17):9774-9778, National Academy of Sciences, United States (2003).

Willis, R.M., et al., "Characterization of a Fatty Acyl-CoA Reductase From Marinobacter Aquaeolei VT8: a Bacterial Enzyme Catalyzing the Reduction of Fatty Acyl-CoA to Fatty Alcohol," Biochemistry 50(48):10550-10558, American Chemical Society, United States (2011).

Wilson, B., "Lubricants and Functional Fluids From Renewable Sources," Industrial Lubrication and Tribology 50(1):6-15, MCB University Press (1998).

Yadav, G., et al., "Computational Approach for Prediction of Domain Organization and Substrate Specificity of Modular Polyketide Synthases," Journal of Molecular Biology 328(2):335-363, Elsevier, England (2003).

Yen, C.L., et al., "Thematic Review Series: Glycerolipids. DGAT Enzymes and Triacylglycerol Biosynthesis," Journal of Lipid Research 49(11):2283-2301, American Society for Biochemistry and Molecular Biology, United States (2008).

Yuzawa, S., et al., "Heterologous Production of Polyketides by Modular Type I Polyketide Synthases in *Escherichia coli*," Current Opinion in Biotechnology 23(5):727-735, Elsevier, Netherlands (2012).

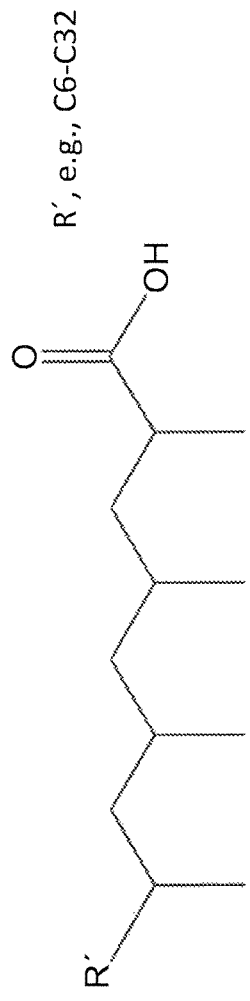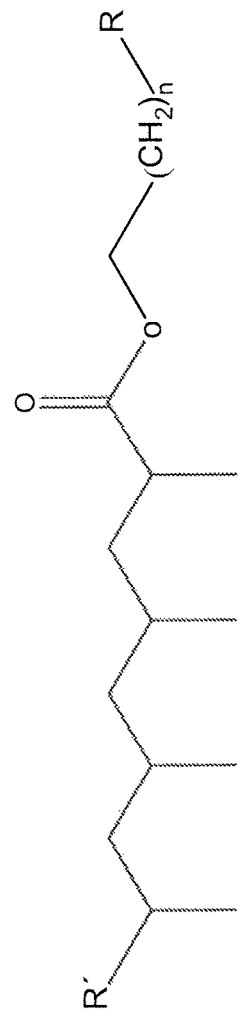
R = Alcohol (e.g., primary, secondary, linear, branched, neo-alcohol)
FIGURE 2

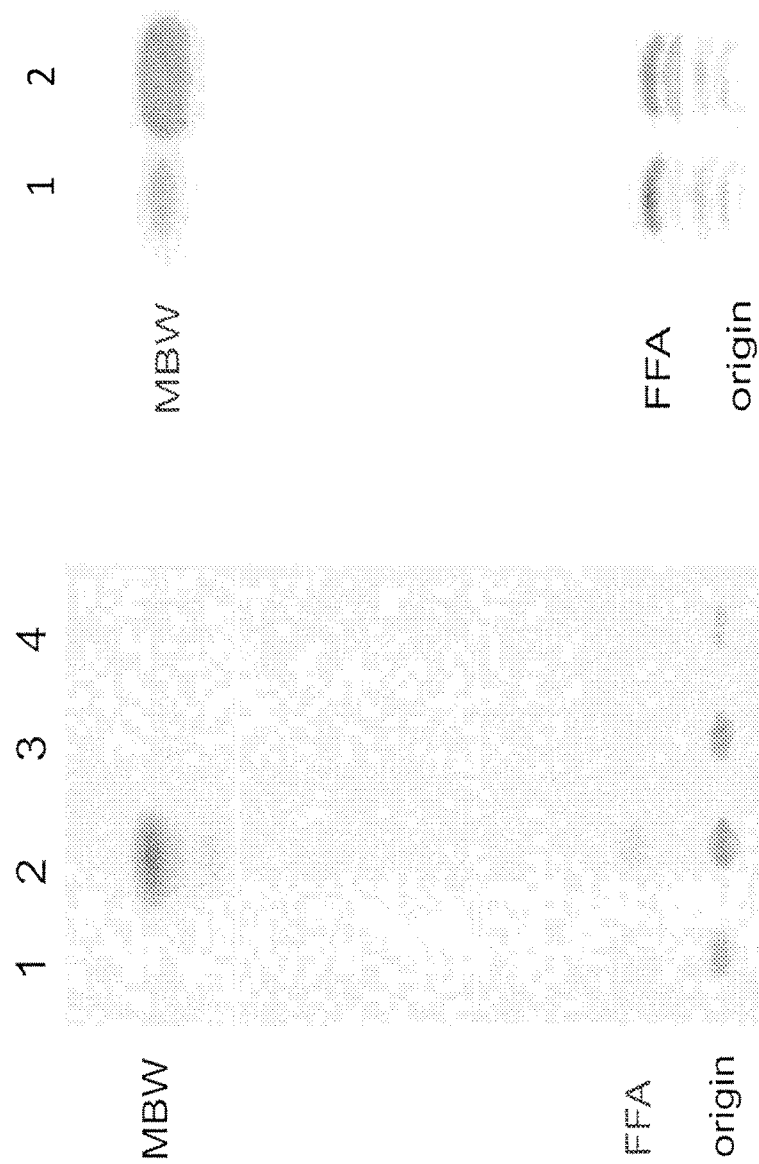

ENGINEERED ORGANISMS FOR PRODUCTION OF NOVEL LIPIDS

REFERENCE TO SEQUENCE LISTING SUBMITTED ELECTRONICALLY VIA EFS-WEB

The content of the electronically submitted sequence listing (Name: 3181_0030001_sequence_listing_ST25.txt; Size: 1,570,158 bytes; and Date of Creation: Sep. 14, 2015) filed with the application is incorporated herein by reference in its entirety.

BACKGROUND

Fossil oils that provide essential fuels and raw materials for industry are finite resources. Accordingly, there is a need for the development of sustainable and renewable sources of lipid compounds to be used for the production of energy and as industrial feedstocks (Campbell et al., Scientific American 1998:78-83).

Bio-renewable oils, such as plant-derived oils, are already major agricultural commodities. Two plant-derived fatty acids, erucic acid and lauric acid, have been competing with petroleum alternatives for many years. Historically, cost has been the major bottleneck limiting the development of new plant-derived oils. Accordingly, in the context of the escalating cost of crude oil and also the increasing concerns about both finite supply and security of supply, there is an emerging strategic need to develop additional renewable products from plant, algae or microorganisms.

There are considerable environmental and economic drivers to develop new and improved bio-based chemicals. Particularly, considering the lubricant industry, vegetable oils are considered a good source of natural lubricants; however their main disadvantages are their poor low temperature fluidity behavior and sensitivity to oxidation at high temperatures. For these reasons vegetable oils are limited in what they can be used for in applications up to 120° C. (Maleque et al., Industrial Lubrication and Tribology 2003, 55:137-143). The main cause of the poor temperature properties of vegetable oils is their molecular structure, i.e., the presence of double bonds on the alkyl side chains and the central β-CH group on the glycerol molecule. The β-hydrogen atom is easily eliminated from the molecular structure through oxidation, which also leads to a weakening of the otherwise very stable ester linkage, and to further degradation of the oil (Wilson, Industrial Lubrication and Tribology 1998, 50:6-15; Wagner et al., Applied Catalysis A: General 2001, 221:429-442).

Double bonds on the carbon chain are especially reactive and react with molecular oxygen to form radicals that lead to polymerization and degradation. Polymerization increases the viscosity of the oil, which reduces its lubrication functionality. Degradation results in breakdown products that are volatile, corrosive and diminish the structure and properties of the lubricants (Kodali, Industrial Lubrication and Tribology 2002, 54:165-170). Inclusion of functional groups such as hydroxyl or branched fatty acids in the base oil itself can therefore improve the properties of the oils. For example, the irregularity imparted by hydroxyl groups or branched-chain fatty acids can disrupt the lipid packing ability of the hydrocarbon chains, thereby reducing the melting temperature of the oil.

Branched-chain fatty acids are carboxylic acids with a methyl or ethyl branch on one or more carbons that can be either chemically synthesized or isolated from certain animals and bacteria. While certain bacteria, such as *Escherichia coli*, do not naturally produce branched-chain fatty acids, some bacteria, such as members of the genera *Bacillus* and *Streptomyces*, can naturally produce these fatty acids. For example, *Streptomyces avermitilis* and *Bacillus subtilis* both produce branched-chain fatty acids with from 14 to 17 total carbons, with the branches in the iso and anteiso positions (Cropp et al., Can. J. Microbiology 46: 506-14, 2000; De Mendoza et al., Biosynthesis and Function of Membrane Lipids, in *Bacillus subtilis* and Other Gram-Positive Bacteria, Sonenshein and Losick, eds., American Society for Microbiology (1993)). However, these organisms do not produce branched-chain fatty acids in amounts that are commercially useful, production is limited to short-chain branched-chain fatty acids, and products having particular branches on particular carbons are not available or cannot be isolated in meaningful quantities.

As such, there remains a need for commercially useful branched-chain fatty acids produced from alternative sources, e.g., engineered microorganisms.

BRIEF SUMMARY

The present disclosure provides engineered microorganisms, engineered biosynthetic pathways, methods of producing lipid compounds using genetically engineered microorganisms, and the products synthesized by those organisms. In particular, the disclosure provides genetically engineered microorganisms for the production of multi-methyl branched fatty acids (MMBFAs) and MMBFA esters (wax esters) derived from these fatty acids. In addition, the disclosure provides methods for producing acylglycerols with one of more of their acyl substituents being an MMBFA, and methods for producing alcohols derived from MMBFAs (fatty alcohols).

Accordingly, the present disclosure provides an engineered microorganism comprising (i) an exogenous or overexpressed polyketide synthase or active fragment thereof and (ii) an exogenous or overexpressed long chain fatty acid AMP ligase, wherein said recombinant microorganism comprises a multi-methyl branched fatty acid (MMBFA) synthesis pathway in which the exogenous or overexpressed polyketide synthase, for example, MAS, catalyzes the iterative conversion of methyl-malonyl-CoA to MMBFA. In some aspects, the polyketide synthase is a MAS (mycocerosic acid synthase) or an active fragment thereof comprising an acyl transferase (AT) domain, an acyl carrier protein (ACP) domain, and a ketide synthase (KS) domain. In some aspects, the polyketide synthase or active fragment thereof comprises SEQ ID NO:1, or a homolog, fragment, or variant thereof. In other aspects, the polyketide synthase or active fragment thereof comprises an amino acid sequence having at least 80% sequence identity to SEQ ID NO:3. In yet other aspects, the MAS further comprises at least a beta-ketoacyl synthase (KS) domain, a dehydratase (DH) domain, an enoyl reductase (ER) domain, a beta-ketoreductase (KR) domain, or a combination thereof. In some aspects, the MAS is a full length MAS. In other aspects, MAS is derived from *Mycobacterium tuberculosis*. In some aspects, the polyketide synthase or active fragment thereof comprises an amino acid sequence having at least 80% sequence identity to PKS2 (SEQ ID NO:15), PKS3 (SEQ ID NO:30), PKS4 (SEQ ID NO:26), PKS5 (SEQ ID NO:37), PKS7 (SEQ ID NO:48), or PKS12 (SEQ ID NO:61) from *Mycobacterium tuberculosis*.

In some aspects, the long chain fatty acid AMP ligase in the engineered microorganism is FADD28. In some aspects, the FADD28 is derived from *Mycobacterium tuberculosis*.

In some aspects, the long chain fatty acid AMP ligase comprises SEQ ID NO:72, or a homolog, active fragment, or variant thereof. In other aspects, the long chain fatty acid AMP ligase comprises an amino acid sequence having at least 80% sequence identity to SEQ ID NO:72. In other aspects, the long chain fatty acid AMP ligase comprises an amino acid sequence having at least 80% sequence identity to FADD21 (SEQ ID NO:72), FADD23 (SEQ ID NO:74), or FADD24 (SEQ ID NO:75) from *Mycobacterium tuberculosis*.

In some aspects, the engineered microorganism further comprises an exogenous or overexpressed ester synthase, wherein said ester synthase catalyzes the transesterification of an MMBFA covalently bound to the ACP domain of MAS with an acceptor alcohol to produce an MMBFA ester. In some aspects, the ester synthase is PAPA5. In other aspects, the ester synthase comprises SEQ ID NO:76, or a homolog, active fragment, or variant thereof. In some aspects, the ester synthase comprises an amino acid sequence having at least 80% sequence identity to SEQ ID NO:76. In other aspects, the PAPA5 is derived from *Mycobacterium tuberculosis*. In some aspects, the ester synthase comprises an amino acid sequence having at least 80% sequence identity to PAPA1 (SEQ ID NO:78), PAPA3 (SEQ ID NO:77), or PAPA4 (SEQ ID NO:79) from *Mycobacterium tuberculosis*.

In other aspects, the MMBFA synthesis pathway in the engineered microorganism further comprises the propionate to propionyl-CoA, propionyl-CoA to methylmalonyl-CoA, or acyl-acyl carrier protein to fatty acid substrate to product conversions, or combinations thereof. In some aspects, the enzyme that catalyzes the conversion of propionate to propionyl-CoA is a propionyl-CoA synthetase. In some aspects, the propionyl-CoA synthetase is PRPE. In some aspects, the propionyl-CoA synthetase comprises SEQ ID NO:80, or a homolog, active fragment, or variant thereof. In other aspects, the propionyl-CoA synthetase comprises an amino acid sequence having at least 80% sequence identity to SEQ ID NO:80. In some aspects, the PRPE is derived from *E. coli*. In other aspects, the enzyme that catalyzes the conversion of propionyl-CoA to methylmalonyl-CoA is an exogenous or overexpressed propionyl-CoA carboxylase (PCC) complex.

In some aspects, the propionyl-CoA carboxylase (PCC) complex comprises SEQ ID NO:81, or a homolog, active fragment, or variant thereof; and/or SEQ ID NO:82, or a homolog, active fragment, or variant thereof; and/or, SEQ ID NO:83, or a homolog, active fragment, or variant thereof; and/or SEQ ID NO:84, or a homolog, active fragment, or variant thereof. In some aspects, the propionyl-CoA carboxylase (PCC) complex comprises an amino acid sequence having at least 80% sequence identity to any one of SEQ ID NO:81, SEQ ID NO:82, SEQ ID NO:83, or SEQ ID NO:84.

In some aspects, the PCC complex is derived from bacteria from the genera *Streptomyces, Mycobacterium, Rhodococcus, Nocardia, Pseudomonas, Corynebacterium, Acinetobacter, Brucella*, or *Burkholderia*. In other aspects, the PCC complex is derived from *Homo sapiens, Acinetobacter baumannii, Brucella suis*, or *Burkholderia glumae*. In specific aspects, the PCC complex is derived from *Streptomyces coelicolor*. In some aspects, the PCC complex comprises ACCA1 (SEQ ID NO:82), PCCB (SEQ ID NO:83), and PCCE (SEQ ID NO:84) proteins from *Streptomyces coelicolor*.

In some aspects, the MMBFA synthesis pathway in the engineered microorganism further comprises a methylmalonate to methylmalonyl-CoA substrate to product conversion. In some aspects, the enzyme that catalyzes the conversion of methylmalonate to methylmalonyl-CoA is an exogenous or overexpressed malonyl/methylmalonyl-CoA ligase. In other aspects, the malonyl/methylmalonyl-CoA ligase is derived from *Streptomyces coelicolor*. In some aspects, the malonyl/methylmalonyl-CoA ligase comprises SEQ ID NO:85, or a homolog, active fragment, or variant thereof. In some aspects, the malonyl/methylmalonyl-CoA ligase comprises an amino acid sequence having at least 80% sequence identity to SEQ ID NO:85. In some aspects, the MMBFA synthesis pathway further comprises a succinyl-CoA to methylmalonyl-CoA substrate to product conversion.

In some aspects, the enzyme that catalyzes the conversion of succinyl-CoA to methylmalonyl-CoA is an exogenous or overexpressed methylmalonyl-CoA mutase/epimerase. In some aspects, the methylmalonyl-CoA mutase/epimerase is derived from *Propionibacterium freudenreichii* subsp. *shermanii*. In other aspects, the methylmalonyl-CoA mutase/epimerase comprises SEQ ID NO:86, or a homolog, active fragment, or variant thereof; and/or SEQ ID NO:87, or a homolog, active fragment, or variant thereof; and/or SEQ ID NO:88, or a homolog, active fragment, or variant thereof. In some aspects, the methylmalonyl-CoA mutase/epimerase comprises an amino acid sequence having at least 80% sequence identity to any one of SEQ ID NO:86, SEQ ID NO:87, or SEQ ID NO:88.

In other aspects, the MMBFA synthesis pathway in the engineered microorganism further comprises an exogenous or overexpressed acyl-acyl carrier protein (ACP) thioesterase that catalyzes the conversion of acyl-acyl carrier protein to fatty acid. In some aspects, the thioesterase is the TESA' protein from *E. coli*. In other aspects, the thioesterase comprises SEQ ID NO:89, or a homolog, active fragment, or variant thereof. In some aspects, the thioesterase comprises an amino acid sequence having at least 80% sequence identity to SEQ ID NO:89.

In other aspects, the MMBFA synthesis pathway in the engineered microorganism further comprises an exogenous or overexpressed phosphopantetheinyl transferase. In some aspects, the 4'-phosphopantetheinyl transferase is an Sft-type 4'-phosphopantetheinyl transferase. In some aspects, the Sfp-type 4'-phosphopantetheinyl transferase is derived from *Bacillus subtilis*. In some aspects, the phosphopantetheinyl transferase comprises SEQ ID NO:90, or a homolog, active fragment, or variant thereof. In other aspects, the phosphopantetheinyl transferase comprises an amino acid sequence having at least 80% sequence identity to SEQ ID NO:90. In still other aspects, the 4'-phosphopantetheinyl transferase gene replaces a genetic locus responsible for propionate catabolism in said microorganism.

The present disclosure also provides an engineered microorganism comprising (i) a MAS polyketide synthase from *Mycobacterium tuberculosis* (SEQ ID NO:3); (ii) a FADD28 long chain fatty acid AMP ligase from *Mycobacterium tuberculosis* (SEQ ID NO:72); (iii) a TESA' thioesterase from *Escherichia coli* (SEQ ID NO:89); and, (iv) a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor*, wherein the MAS polyketide synthase catalyzes the iterative conversion of methyl-malonyl-CoA to MMBFA. In some aspects, the engineered microorganism further comprises a PAPA5 ester synthase from *Mycobacterium tuberculosis* (SEQ ID NO:76), wherein the ester synthase catalyzes the transesterification of an MMBFA with an acceptor alcohol to produce an MMBFA ester.

Also provided in the present disclosure is an engineered microorganism comprising (i) a PKS3/4 polyketide synthase from *Mycobacterium tuberculosis* (SEQ ID NO:26); (ii) a FADD21 long chain fatty acid AMP ligase from *Mycobacterium tuberculosis* (SEQ ID NO:73); (iii) a TESA' thioesterase from *Escherichia coli* (SEQ ID NO:89); and, (iv) a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor*, wherein the PKS3/4 polyketide synthase catalyzes the iterative conversion of methyl-malonyl-CoA to MMBFA. In some aspects, the engineered microorganism further comprises a PAPA3 ester synthase from *Mycobacterium tuberculosis* (SEQ ID NO:77), wherein the ester synthase catalyzes the transesterification of an MMBFA with an acceptor alcohol to produce an MMBFA ester.

The instant disclosure also provides an engineered microorganism comprising (i) a PKS2 polyketide synthase from *Mycobacterium tuberculosis* (SEQ ID NO:15); (ii) a FADD23 long chain fatty acid AMP ligase from *Mycobacterium tuberculosis* (SEQ ID NO:74); (iii) a TESA' thioesterase from *Escherichia coli* (SEQ ID NO:89); and, (iv) a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor*, wherein the PKS2 polyketide synthase catalyzes the iterative conversion of methyl-malonyl-CoA to MMBFA. In some aspects, the engineered microorganism further comprises a PAPA1 ester synthase from *Mycobacterium tuberculosis* (SEQ ID NO:78), wherein the ester synthase catalyzes the transesterification of an MMBFA with an acceptor alcohol to produce an MMBFA ester.

The instant disclosure also provides an engineered microorganism comprising (i) a PKS5 polyketide synthase from *Mycobacterium tuberculosis* (SEQ ID NO:37); (ii) a FADD24 long chain fatty acid AMP ligase from *Mycobacterium tuberculosis* (SEQ ID NO:75); (iii) a TESA' thioesterase from *Escherichia coli* (SEQ ID NO:89); and, (iv) a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor*, wherein the PKS5 polyketide synthase catalyzes the iterative conversion of methyl-malonyl-CoA to MMBFA. In some aspects, the engineered microorganism further comprises a PAPA4 ester synthase from *Mycobacterium tuberculosis* (SEQ ID NO:79), wherein the ester synthase catalyzes the transesterification of an MMBFA with an acceptor alcohol to produce an MMBFA ester.

In some aspects, the engineered microorganism is selected from the group consisting of bacteria, fungi, yeast, and algae. In some aspects, the bacteria is selected from the genera *Streptomyces, Rhodococcus, Mycobacterium, Escherichia, Corynebacterium, Pseudomonas, Nocardia*, or *Bacillus*. In specific aspects, the bacteria is *Escherichia coli, Streptomyces coelicolor*, or *Rhodococcus opacus*. In some aspects, the yeast is selected from the genera *Saccharomyces, Kluyveromyces, Pachysolen, Zygosaccharomyces, Debaryomyces, Pichia, Schizosaccharomyces, Candida, Issatchenkia, Hansenula, Yarrowia, Tricosporon, Rhodotorula*, or *Myxozyma*. In other aspects, the yeast is *Saccharomyces cerevisiae, Saccharomyces uvarum, Saccharomyces bayanus, Saccharomyces paradoxus, Saccharomyces casteff, Saccharomyces kluyveri, Kluyveromyces thermotolerans, Kluyveromyces lactis, Kluyveromyces marxianus, Kluyveromyces waltii, Pachysolen tannophilis, Zygosaccharomyces baifi, Zygosaccharomyces rouxii Debaryomyces hansenii, Debaromyces carsonii, Pichia pastorius, Pichia anomala, Pichia stipitis, Pichia castillae, Schizosaccharomyces pombe, Candida utilis, Candida glabrata, Candida tropicalis, Candida xestobii, Issatchenkia orientalis, Issatchenkia occidentalis, Issatchenkia scutulata, Hansenula anomala*, or *Yarrowia lipolytica*. In some aspects, the algae is selected from the genera *Monalanthus, Botryococcus, Chlorella, Outirococcus, Scenedesmus, Nannochloris, Dunaliella, Navicula, Radiosphaera, Biddulphia, Nitzschia, Ochromonas, Peridinium, Neochloris, Oocystis, Chrysochromulina, Prymnesium, Scotiella, Euglena, Porphyridium, Tetraselmis*, or *Chlamydomonas*. In specific aspects, the algae is *Monalanthus salina, Botryococcus braunii, Chlorella prototecoides, Scenedesmus obliquus, Dunaliella bardawil, Navicula pelliculosa, Radiosphaera negevensis, Biddulphia aurita, Chlorella vulgaris, Nitzschia palea, Ochromonas dannica, Chrorella pyrenoidosa, Peridinium cinctum, Neochloris oleabundans, Oocystis polymorpha, Scenedesmus acutus, Chlorella minutissima, Prymnesium parvum, Navicula pelliculosa, Scenedesmus dimorphus, Euglena gracilis*, or *Porphyridium cruentum.*

In some aspects, the MMBFA produced by the engineered microorganism has a fatty acid chain length of about 10 to about 40 carbons, and at least one branching at an even position carbon. In other aspects, the MMBFA comprises at least one methyl branch. In some aspects, the MMBFA comprises 2 to four methyl branches located at carbons 2, 4, 6, and 8 of the fatty acid chain. In some aspects, the MMBFA comprises at least one unsaturation. In some aspects, the at least one unsaturation is located between carbons 17 and 18 of the fatty acid chain.

In some aspects, the engineered microorganism produces MMBFA ester using as the acceptor alcohol a primary alcohol, a secondary alcohol, a tertiary alcohol, or a combination thereof. In some aspects, the acceptor alcohol is a linear alcohol or a branched alcohol. In other aspects, the acceptor alcohol is a neo-alcohol. In some aspects, the acceptor alcohol is a monovalent alcohol, a divalent alcohol, or a combination thereof. In some aspects, the monovalent alcohol is ethanol, 1-butanol, 1-pentanol, 2-propanol, 2-butanol, 1-octanol, (+/−) 2-octanol, (R)-(−)-2-octanol, 1-nonanol, 1-decanol, (+/−) 2-undecanol, myristyl alcohol (1-tetradecanol), palmityl alcohol (1-hexadecanol), stearyl alcohol (1-octadecanol), 1-eicosanol, trans-2-octene-1-ol, DL-3-OH-methyl palmitate, or a combination thereof. In some aspects, the divalent alcohol is (S)-(−)-1,2-decanediol, (R)-1,2-decanediol, (+/−) 1,2-octanediol, or a combination thereof. In some aspects, the neo-alcohol is trimethylpropane, pentaerythrite, neopentylclycol, or a combination thereof. In certain aspects, the MMBFA ester product has an ester chain length of about 2 to about 24 carbons.

In some aspects, the MMBFA ester product of an engineered microorganism disclosed herein comprises octyl 2,4,6,8-tetramethyltetracosanoate; (Z)-octyl 2,4,6,8-tetramethylhexacos-17-enoate; (Z)-octyl 2,4,6,8-tetramethyltetracos-17-enoate; octyl 2,4,6,8-tetramethyltriacontonoate; ethyl 2,4,6,8-tetramethyltetracosanoate; (Z)-ethyl 2,4,6,8-tetramethylhexacos-17-enoate; (Z)-ethyl 2,4,6,8-tetramethyltetracos-17-enoate; ethyl 2,4,6,8-tetramethyltriacontanoate; pentyl 2,4,6,8-tetramethyltetracosanoate; (Z)-pentyl 2,4,6,8-tetramethylhexacos-17-enoate; (Z)-pentyl 2,4,6,8-tetramethyltetracos-17-enoate; pentyl 2,4,6,8-tetramethyltriacontonoate; butyl 2,4,6,8-tetramethyltetracosanoate; (Z)-butyl 2,4,6,8-tetramethylhexacos-17-enoate; (Z)-butyl 2,4,6,8-tetramethyltetracos-17-enoate; butyl 2,4,6,8-tetramethyltriacontonoate; and combinations thereof.

In some aspects, at least one gene encoding one of the exogenous or overexpressed enzymes in the engineered microorganism has been subjected to molecular evolution to enhance the enzymatic activity of the enzyme. In other aspects, at least one gene encoding one of the exogenous or overexpressed enzymes has been mutated to enhance the enzymatic activity of the enzyme.

The present disclosure also provides an engineered MMBFA synthesis pathway comprising (i) an exogenous or overexpressed polyketide synthase, and (ii) an exogenous or overexpressed long chain fatty acid AMP ligase, wherein the exogenous or overexpressed polyketide synthase catalyzes the iterative conversion of methyl-malonyl-CoA to MMBFA.

Also provided in the instant disclosure is a method of producing an MMBFA and/or an MMBFA product comprising (a) providing the engineered microorganism of the present disclosure, and (b) cultivating the engineered microorganism in a culture medium containing a feedstock providing a carbon source for a period of time and under conditions to produce a recoverable amount of MMBFA and/or MMBFA product. In some aspects, the method further comprises separating the MMBFA and/or MMBFA product from the culture. In some aspects, the separation of the MMBFA provides a yield of at least 1 gram per liter of culture. In some aspects, the MMBFA product is an MMBFA ester. In some aspects, the separation of MMBFA ester provides a yield of at least 1 gram per liter of culture.

Also provided in the instant disclosure is a method to recover an MMBFA comprising (i) extracting the MMBFA, wherein the extraction yields a MMBFA-rich phase, (ii) separating the MMBFA-rich phase, and (iii) recovering the MMBFA from the MMBFA-rich phase, wherein the MMBFA is produced by one of the MMBFA-producing engineered microorganism disclosed herein.

Also provided is a method to recover an MMBFA ester comprising (i) extracting the MMBFA ester, wherein the extraction yields a MMBFA ester-rich phase, (ii) separating the MMBFA ester-rich phase, and (iii) recovering the MMBFA ester from the MMBFA ester-rich phase, wherein the MMBFA ester is produced by one of the MMBFA ester-producing engineered microorganism disclosed herein.

The instant disclosure also provides an MMBFA produced according to the methods disclosed herein. Also provided is an MMBFA ester produced according to the methods disclosed herein. In some aspects, the MMBFA comprises (i) a fatty acid chain length of about 10 to about 40 carbons; (ii) at least 4 methyl branches located at position 2, 4, 6, and 8 of the fatty acid chain; and, (iii) zero or one unsaturation in the fatty acid chain. In some aspects, at least one methyl branch is located at position 10, 12, or 14 of the fatty acid chain. In some aspects, the MMBFA ester comprises (i) a fatty acid chain length of about 10 to about 40 carbons; (ii) at least 4 methyl branches located at position 2, 4, 6, and 8 of the fatty acid chain; (iii) zero or one unsaturation in the fatty acid chain; and, (iv) an ester chain length of about 12 to about 64 carbons. In some aspects, at least one methyl branch is located at position 10, 12, or 14 of the fatty acid chain. In some aspects, the MMBFA or MMBFA ester is a base lubricant, biofuel, detergent, soap, cosmetic, or emulsifier.

Also provided is a composition comprising an MMBFA and/or MMBFA product produced by the engineered microorganism disclosed herein, wherein the composition is, for example, a base lubricant, biofuel, detergent, soap, cosmetic, or emulsifier. The present disclosure also provides a composition comprising an MMBFA and/or MMBFA product produced in a cell free system comprising the engineered pathway disclosed herein, wherein the composition is, for example, a base lubricant, biofuel, detergent, soap, cosmetic, or emulsifier. The instant disclosure also provides a composition comprising an MMBFA and/or MMBFA product produced according to the methods disclosed herein, wherein the composition is, for example, a base lubricant, biofuel, detergent, soap, cosmetic, or emulsifier.

BRIEF DESCRIPTION OF THE DRAWINGS/FIGURES

FIG. 1 shows the domain organizations of representative type I fatty acid synthases (FAS) and related multi-domain enzymes such as MAS (mycorosic acid synthases) and PKS (polyketide syntheses). Arrows indicate open reading frames. The subdivisions into functional domains are not shown to scale. The functional domains showed are: AC, acyltransferase; AT or MPT, malonyl/acetyl- or malonyl/palmitoyl-transacylase; KS, ketoacyl synthase; KR, ketoacyl redutase; DH dehydratase; ER enoyl reductase; ACP acyl carrier protein; TE thioesterase; and PPT, phosphopantheteine transferase.

FIG. 2 shows exemplary structures of MMBFAs and their esters produced according to the methods disclosed in the instant application.

FIG. 3 is a diagram showing an exemplary engineered MMBFA ester (wax ester) biosynthetic pathway. The MAS enzyme elongates a fatty acid starter molecule by iterative rounds of condensation with methylmalonyl-CoA. The PAPA5 enzyme catalyzes the trans-esterification of the acylated product covalently bound to the ACP domain of MAS with an acceptor alcohol to form the wax ester.

FIG. 4 is an autoradiograph of thin layer chromatography (TLC) analysis of MMBFA esters produced in recombinant E. coli strains comprising an engineered biosynthetic pathway. Cells were cultivated for 20 hours at 22° C. in LB medium after induction with IPTG and arabinose, and supplementation with oleate, n-octanol and [$^{14}$C]-propionate/propionate. Total lipid extracts obtained from the same amount of cells were applied to lanes 1 to 4. Lanes: 1, E. coli strain MB01/pRT23; 2, E. coli strain MB01/pRT23/pMB09; 3, E. coli strain MB01/pRT23/pMB07; 4, E. coli strain MB01/pRT23/pMB06. FFA=Free Fatty Acid (MMBFA); MBW=MMBFA ester.

FIG. 5 shows the TLC analysis of MMBFA ester produced in the recombinant E. coli strain BM01/pRT23/pMB09 cultivated for 20 hours at 22° C. in LB medium after induction with IPTG and supplementation with n-octanol and propionate. Total lipid extracts obtained from the same amount of cells were applied to lanes 1 and 2. Lanes: 1, sample without oleate; 2, sample including addition of 0.1% oleate. FFA=Free Fatty Acid (MMBFA); MBW=MMBFA ester.

FIG. 6 is an autoradiogrpah of TLC analysis of MMBFA ester produced in the recombinant E. coli BM01/pRT23/pMB09 strain cultivated for 20 hours at 22° C. in LB medium after induction with IPTG and arabinose, and supplementation with oleate and propionate. Total lipid extracts obtained from the same amount of cells were applied to lanes 1 and 4. Lanes: 1, ethanol; 2, butanol solubilized in ethanol; 3, pentanol solubilized in ethanol, 4, octanol solubilized in ethanol, 5 octanol. *[$^{14}$C]-propionate (PerkinElmer, is solubilized in ethanol). FFA=Free Fatty Acid (MMBFA); MBW=MMBFA ester.

Figure 9:
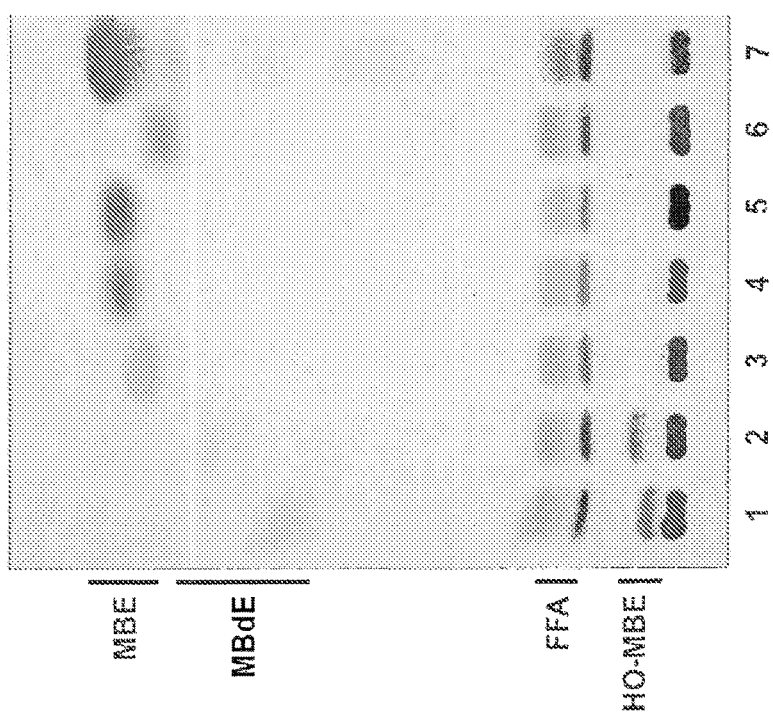

FIG. 9 shows MMBFA esters produced by the recombinant E. coli strain MB04 supplemented with different alcohol molecules. The radio-TLC analysis corresponds total lipid extracts obtained from induced cultures of E. coli strain MB04 which were supplemented with ethyleneglycol (lane 1), propyleneglycol (lane 2), isopropanol (lane 3), isobutanol (lane 4), isopentanol (lane 5), methanol (lane 6), and n-octanol (lane 7). MBE: multi-methylbranched-ester; MBdE: multi-methylbranched-diester, HO-MBE: hydroxyl MBE; FFA: free fatty acid.

DETAILED DESCRIPTION

The present disclosure provides engineered microorganisms, engineered synthesis pathways, methods of producing lipid compounds by microbial organisms through genetic engineering, and the products synthesized by those organisms and their derivatives. In particular, the disclosure provides genetically engineered microorganisms for the production of multi-methyl branched fatty acids (MMBFAs) and MMBFA esters (wax esters) derived from these fatty acids. In addition, the disclosure provides methods for producing acylglycerols, e.g., triacylglycerols, with one of more of their acyl substituents being an MMBFA, and methods for producing alcohols derived from MMBFAs.

Definitions

It must be noted that, as used in this specification and the appended claims, the singular forms "a," "an" and "the" include plural referents unless the context clearly dictates otherwise. The terms "a" (or "an"), as well as the terms "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

It is understood that wherever embodiments are described herein with the language "comprising," otherwise analogous embodiments described in terms of "consisting of" and/or "consisting essentially of" are also provided.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Systéme International de Unites (SI) accepted form. Numeric ranges are inclusive of the numbers defining the range. Unless otherwise indicated, amino acid sequences are written left to right in amino to carboxy orientation. The headings provided herein are not limitations of the various aspects or embodiments of the disclosure, which can be had by reference to the specification as a whole. Accordingly, the terms defined immediately below are more fully defined by reference to the specification in its entirety. Amino acids are referred to herein by either their commonly known three letter symbols or by the one-letter symbols recommended by the IUPAC-IUB Biochemical Nomenclature Commission. Nucleotides, likewise, are referred to by their commonly accepted single-letter codes.

The term "microorganism" includes prokaryotic and eukaryotic microbial species from the domains Archaea, Bacteria, and Eucarya, the latter including yeast and filamentous fungi, protozoa, algae, or higher Protista. The term is not limited to naturally occurring species, i.e., the term also includes engineered microorganisms.

In the context of microorganisms, the term "genus" is defined as a taxonomic group of related species according to the Taxonomic Outline of Bacteria and Archaea (Garrity, G. M., Lilburn, T. G., Cole, J. R., Harrison, S. H., Euzeby, J., and Tindall, B. J. (2007) The Taxonomic Outline of Bacteria and Archaea. TOBA Release 7.7, March 2007. Michigan State University Board of Trustees).

In the context of microorganisms, the term "species" is defined as a collection of closely related organisms with greater than 97% 16S ribosomal RNA sequence homology and greater than 70% genomic hybridization and sufficiently different from all other organisms so as to be recognized as a distinct unit (see, e.g., Petti, C. A. 2007. Detection and identification of microorganisms by gene amplification and sequencing. Clin. Infect. Dis. 44:1108-1114).

The terms "engineered microorganism," "modified microorganism," "recombinant microorganism," "engineered host cell," and "engineered cell," are used interchangeably herein and refer to microorganisms that have been genetically modified to express or over-express endogenous polynucleotides, or to express heterologous polynucleotides, such as those included in a vector, or which have an alteration in expression of an endogenous gene, for example, a gene encoding for an enzyme. By "alteration" it is meant that the expression of the gene, or level of a RNA molecule or equivalent RNA molecules encoding one or more polypeptides or polypeptide subunits, or activity of one or more polypeptides or polypeptide subunits is up regulated or down regulated, such that expression, level, or activity is greater than or less than that observed in the absence of the alteration. It is understood that the terms "engineered microorganism" and "engineered host cell" refer not only to the particular microorganism but to the progeny or potential progeny of such a microorganism. Because certain modifications can occur in succeeding generations due to either mutation or environmental influences, such progeny may not, in fact, be identical to the parent cell, but are still included within the scope of the term as used herein.

The term "engineer" refers to any manipulation of a microorganism that results in a detectable change in the microorganism, wherein the manipulation includes but is not limited to inserting a polynucleotide and/or polypeptide heterologous to the microorganism and mutating a polynucleotide and/or polypeptide native to the microorganism. The term "mutation" as used herein indicates any modification of a nucleic acid and/or polypeptide which results in an altered nucleic acid or polypeptide. Mutations include, for example, point mutations, deletions, or insertions of single or multiple residues in a polynucleotide, which includes alterations arising within a protein-encoding region of a gene as well as alterations in regions outside of a protein-encoding sequence, such as, but not limited to, regulatory or promoter sequences. A genetic alteration can be a mutation of any type. For instance, the mutation can constitute a point mutation, a frame-shift mutation, an insertion, or a deletion of part or all of a gene. In addition, in some embodiments of the modified microorganism, a portion of the microorganism genome has been replaced with a heterologous polynucleotide. In some embodiments, the mutations are naturally-occurring. In other embodiments, the mutations are the results of artificial selection pressure. In still other embodiments, the mutations in the microorganism genome are the result of genetic engineering.

The term "expression" with respect to a gene sequence refers to transcription of the gene and, as appropriate, translation of the resulting mRNA transcript to a protein. Thus, as will be clear from the context, expression of a protein results from transcription and translation of the open reading frame sequence. The level of expression of a desired product, e.g., an enzyme in an engineered host cell can be determined on the basis of either the amount of corresponding mRNA that is present in the cell, or the amount of the desired product encoded by the selected sequence. For example, mRNA transcribed from a selected sequence can be quantitated by qRT-PCR or by Northern hybridization (see Sambrook et al., Molecular Cloning: A Laboratory Manual, Cold Spring Harbor Laboratory Press (1989)).

As used herein, "overexpression" refers to expression of a polynucleotide to produce a product (e.g., a polypeptide or RNA) at a higher level than the polynucleotide is normally expressed in the host cell. An overexpressed polynucleotide is generally a polynucleotide native to the host cell, the product of which is generated in a greater amount than that normally found in the host cell. Overexpression is achieved by, for instance and without limitation, operably linking the polynucleotide to a different promoter than the polynucleotide's native promoter or introducing additional copies of the polynucleotide into the host cell.

In addition to overexpression, the increased flow in the engineered metabolic pathways can be accomplished by upregulation. For example, the host cell can be modified to increase carbon flow to propionyl-CoA (and then onward to methylmalonyl-CoA) by, for example, increasing expression of (i.e., by overexpression) of PRPE or other propionyl-CoA synthetase genes. Alternatively or in addition, an exogenous polynucleotide comprising a nucleic acid sequence encoding a propionyl-CoA synthetase can be introduced into the host cell to upregulate propionyl-CoA production. Expression can also be upregulated by indirect action on DNA regulatory elements. Carbon flow modification can also be accomplished by modification of the cell culture media. For example feeding host cells large amounts of methionine, isoleucine, valine, threonine, propionic acid, and/or off-chain length fatty acids (such as valeric acid) can be used to increase production of the propionyl-CoA precursor of methylmalonyl-CoA. In addition, carbon flow through the engineered metabolic pathway can be modified by attenuation of endogenous enzyme activity responsible for the diversion of carbon flow to branch pathways not contributing to the formation of the desired product. For example, the production of acylglycerides, e.g., triacylglycerides, containing MMBFAs can be attenuated in order to promote the accumulation of free MMBFAs. Complete abolishment of endogenous activity is not required. Enzyme activity can be attenuated (i.e., reduced or abolished) by, for example, mutating the coding sequence for the enzyme to create a non-functional or reduced-function polypeptide, by removing part or all of the coding sequence from the host's genome, or interfering with transcription or translation.

Proteins encoded by a selected sequence can be quantitated by various methods, e.g., by ELISA, by assaying for the biological activity of the protein, or by employing assays that are independent of such activity, such as western blotting or radioimmunoassay, using antibodies that recognize and bind the protein. The polynucleotide generally encodes a target enzyme involved in a metabolic pathway for producing a desired metabolite.

As used herein, "amplify," "amplified," or "amplification" refers to any process or protocol for copying a polynucleotide sequence into a larger number of polynucleotide molecules, e.g., by reverse transcription, polymerase chain reaction, and ligase chain reaction.

As used herein, the carbons in fatty acids are numbered with the first carbon as part of the carboxylic acid group, and the second carbon (C2) adjacent to the first. The numbers continue so that the highest number carbon is farthest from the carboxylic acid group. Accordingly, "even numbered" carbons include C2, C4, C6, C8, C10, C12, C14, C16, C18, C20, C22, C24, C26, C28, C30, C32, C34, C36, C38, C40, and so on.

As used herein, "encoding" refers to the inherent property of nucleotides to serve as templates for synthesis of other polymers and macromolecules. Unless otherwise specified, a "nucleotide sequence encoding an amino acid sequence" includes all nucleotide sequences that are degenerate versions of each other and that encode the same amino acid sequence.

As used herein, "endogenous" refers to polynucleotides, polypeptides, or other compounds that are expressed naturally or originate within an organism or cell, for example, a microorganism. That is, endogenous polynucleotides, polypeptides, or other compounds are not exogenous. For instance, an "endogenous" polynucleotide or peptide is present in the cell when the cell was originally isolated from nature.

As used herein, "exogenous" refers to any polynucleotide or polypeptide that is not naturally expressed or produced in the particular cell or organism where expression is desired. Exogenous polynucleotides, polypeptides, or other compounds are not endogenous.

As used herein, "expression vector" refers to a vector comprising a recombinant polynucleotide comprising expression control sequences operatively linked to a nucleotide sequence to be expressed. For example, suitable expression vectors include, without limitation, autonomously replicating vectors or vectors integrated into the chromosome. In some instances, an expression vector is a viral-based vector.

As used herein, "recombinant expression vector" refers to a DNA construct used to express a polynucleotide that encodes a desired polypeptide. A recombinant expression vector can include, for example, a transcriptional subunit comprising (i) an assembly of genetic elements having a regulatory role in gene expression, for example, promoters and enhancers, (ii) a structural or coding sequence which is transcribed into mRNA and translated into protein, and (iii) appropriate transcription and translation initiation and termination sequences. Recombinant expression vectors are constructed in any suitable manner. The nature of the vector is not critical, and any vector can be used, including plasmid, virus, bacteriophage, and transposon. Possible vectors for use in the invention include, but are not limited to, chromosomal, nonchromosomal and synthetic DNA sequences, e.g., bacterial plasmids; phage DNA; yeast plasmids; and vectors derived from combinations of plasmids and phage DNA, DNA from viruses such as vaccinia, adenovirus, fowl pox, baculovirus, SV40, and pseudorabies.

As used herein, the term "polypeptide" refers to a molecule composed of monomers (amino acids) linearly linked by amide bonds (also known as peptide bonds). The term "polypeptide" refers to any chain or chains of two or more amino acids, and does not refer to a specific length of the product. As used herein the term "protein" is intended to encompass a molecule comprised of one or more polypeptides, which can in some instances be associated by bonds other than amide bonds. On the other hand, a protein can also be a single polypeptide chain. In this latter instance the single polypeptide chain can in some instances comprise two or more polypeptide subunits fused together to form a protein. The terms "polypeptide" and "protein" also refer to the products of post-expression modifications, including without limitation glycosylation, acetylation, phosphorylation, amidation, derivatization by known protecting/blocking groups, proteolytic cleavage, or modification by non-naturally occurring amino acids. A polypeptide or protein can be derived from a natural biological source or produced by recombinant technology, but is not necessarily translated from a designated nucleic acid sequence. It can be generated in any manner, including by chemical synthesis.

An "isolated" polypeptide, antibody, polynucleotide, vector, cell, or composition is a polypeptide, antibody, polynucleotide, vector, cell, or composition that is in a form not found in nature. Isolated polypeptides, antibodies, polynucleotides, vectors, cells or compositions include those which have been purified to a degree that they are no longer in a form in which they are found in nature. In some aspects, an "isolated" enzyme, polynucleotide, vector, cell, or composition is substantially pure.

A "recombinant" polypeptide or protein refers to a polypeptide or protein produced via recombinant DNA technology. Recombinantly produced polypeptides and proteins expressed in host cells are considered isolated for the purpose of the present disclosure, as are native or recombinant polypeptides which have been separated, fractionated, or partially or substantially purified by any suitable technique.

Also included in the present disclosure are homologs, fragments, variants, or derivatives of the enzymes disclosed herein, and any combination thereof.

The term "enzyme" as used herein refers to any substance that catalyzes or promotes one or more chemical or biochemical reactions. Enzymes can be totally or partially composed of a polypeptide, but can also include be composed of or include a different molecule, e.g., a polynucleotide.

The terms "fragment" and "active fragment" when referring to polypeptides or proteins of the present disclosure are used interchangeably and include any polypeptides or proteins that retain at least some of the properties of the reference polypeptide or protein. A fragment of polypeptide can include, for example, a proteolytic fragment, as well as a deletion fragment. Accordingly, the term "fragment" as used in the present disclosure as applied to an enzyme in an engineered metabolic pathway, refers to an active fragment of such enzyme, i.e., a fragment which still is capable of catalyzing (even with substantially less efficiency or specificity) the substrate to product conversion catalyzed by the full-length protein or by a specific catalytically active domain of the parent protein (e.g., the AT domain in the mycocerosic acid synthetase (MAS) from *Mycobacterium tuberculosis*). In this respect, the term "active fragment" as applied to a polyketide synthase (PKS) refers to a peptide fragment having acyltransferase enzymatic activity. In some aspects of the present disclosure, the PKS active fragments refers to a construct containing the KS (ketosynthase), AT (acyltransferase) and ACP (acyl-carrier protein) domains of the PKS, for example, the AT, KS, and ACP domains of the MAS enzyme.

The term "homolog," used with respect to an enzyme or gene of a first family or species, refers to distinct enzymes or genes of a second family or species which are determined by functional, structural, or genomic analyses to be an enzyme or gene of the second family or species which corresponds to the original enzyme or gene of the first family or species. As used herein, the term "homolog" refers to any gene that is related to a reference enzyme or gene by descent from a common ancestral DNA sequence. The term homolog includes both orthologs and paralogs.

The term "ortholog" refers to homologs in different species that evolved from a common ancestral gene by speciation. Typically, orthologs retain the same or similar function despite differences in their primary structure (mutations).

The term "paralog" refers to homologs in the same species that evolved by genetic duplication of a common ancestral gene. In many cases, paralogs exhibit related (but not always identical functions). To the extent that a particular species has evolved multiple related genes from an ancestral DNA sequence shared with another species, the term ortholog can encompass the term paralog.

Most often, homologs will have functional, structural, or genomic similarities. Techniques are known by which homologs of an enzyme or gene can readily be cloned using genetic probes and PCR. Identity of cloned sequences as homologs can be confirmed using functional assays and/or by genomic mapping of the genes.

The term "variant" as used herein refers to a polypeptide sequence that differs from that of a parent polypeptide sequence by virtue of at least one amino acid modification. The parent polypeptide can be a naturally occurring polypeptide, i.e., a "wild-type" polypeptide, or can be a modified version of a wild-type polypeptide. The term variant polypeptide can refer to the polypeptide itself, a composition comprising the polypeptide, or the amino sequence that encodes it.

In certain aspects, the variant polypeptide has at least one amino acid modification compared to the parent polypeptide, e.g., from about one to about ten amino acid modifications, for example, from about one to about six amino acid modifications compared to the parent polypeptide. The variant polypeptide sequence herein will generally possess at least about 90% sequence identity with a parent polypeptide sequence, and most generally at least about 95% sequence identity.

Variants of polypeptides or proteins of the present disclosure include fragments as described above, and also polypeptides or proteins with altered amino acid sequences due to amino acid substitutions, deletions, or insertions. Variants can be naturally or non-naturally occurring. Non-naturally occurring variants can be produced using art-known mutagenesis techniques. Variant polypeptides can comprise conservative or non-conservative amino acid substitutions, deletions or additions.

The term "derivatives" as applied to polypeptides or proteins refers to polypeptides or proteins that have been altered so as to exhibit additional features not found on the native polypeptide or protein, e.g., via fusion or conjugation with other components.

In the context of the present disclosure, it is understood that homologs (either orthologs or paralogs), fragments, variants, mutants or derivatives of an enzyme to be used in an engineered microorganism and engineered metabolic pathways disclosed herein can catalyze the same substrate to product conversion as the original enzyme. In some aspects, the fragments, variants, mutants or derivatives of an enzyme can have different catalytic rates, substrate specificity, stabilities, and capabilities to interact with other proteins, with respect to the original enzyme. As will be understood by one of ordinary skill in the art, modified enzymes (fragments, variants, mutants, and/or derivatives) can be obtained by genetic engineering techniques that are routine and well known in the art.

The terms "polynucleotide" or "nucleotide" as used herein are intended to encompass a singular nucleic acid as well as plural nucleic acids, and refers to an isolated nucleic acid molecule or construct, e.g., messenger RNA (mRNA) or plasmid DNA (pDNA). In certain aspects, a polynucleotide comprises a conventional phosphodiester bond or a non-conventional bond (e.g., an amide bond, such as found in peptide nucleic acids (PNA)).

The term "nucleic acid" refers to any one or more nucleic acid segments, e.g., DNA or RNA fragments, present in a polynucleotide. When applied to a nucleic acid or polynucleotide, the term "isolated" refers to a nucleic acid molecule, DNA or RNA, which has been removed from its native environment, for example, a recombinant polynucleotide encoding an polypeptide comprising an enzyme contained in a vector is considered isolated for the purposes of the present disclosure. Further examples of an isolated polynucleotide include recombinant polynucleotides maintained in heterologous host cells or purified (partially or substantially) from other polynucleotides in a solution. Isolated RNA molecules include in vivo or in vitro RNA transcripts of polynucleotides of the present disclosure. Isolated polynucleotides or nucleic acids according to the present disclosure further include such molecules produced synthetically. In addition, a polynucleotide or a nucleic acid can include regulatory elements such as promoters, enhancers, ribosome binding sites, or transcription termination signals.

The present disclosure also encompasses polypeptides comprising a comprising one or more conservative amino acid substitutions. A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, if an amino acid in a polypeptide is replaced with another amino acid from the same side chain family, the substitution is considered to be conservative. In another aspect, a string of amino acids can be conservatively replaced with a structurally similar string that differs in order and/or composition of side chain family members.

The term "percent sequence identity" between two polynucleotide or polypeptide sequences refers to the number of identical matched positions shared by the sequences over a comparison window, taking into account additions or deletions (i.e., gaps) that must be introduced for optimal alignment of the two sequences. A matched position is any position where an identical nucleotide or amino acid is presented in both the target and reference sequence. Gaps presented in the target sequence are not counted since gaps are not nucleotides or amino acids. Likewise, gaps presented in the reference sequence are not counted since target sequence nucleotides or amino acids are counted, not nucleotides or amino acids from the reference sequence.

The percentage of sequence identity is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity. The comparison of sequences and determination of percent sequence identity between two sequences can be accomplished using readily available software both for online use and for download. Suitable software programs are available from various sources, and for alignment of both protein and nucleotide sequences. One suitable program to determine percent sequence identity is bl2seq, part of the BLAST suite of program available from the U.S. government's National Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute at www.ebi.ac.uk/Tools/psa.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

One skilled in the art will appreciate that the generation of a sequence alignment for the calculation of a percent sequence identity is not limited to binary sequence-sequence comparisons exclusively driven by primary sequence data. Sequence alignments can be derived from multiple sequence alignments. One suitable program to generate multiple sequence alignments is ClustalW2, available from www.clustal.org. Another suitable program is MUSCLE, available from www.drive5.com/muscle/. ClustalW2 and MUSCLE are alternatively available, e.g., from the European Bioinformatics Institute.

It will also be appreciated that sequence alignments can be generated by integrating sequence data with data from heterogeneous sources such as structural data (e.g., crystallographic protein structures), functional data (e.g., location of mutations), or phylogenetic data. A suitable program that integrates heterogeneous data to generate a multiple sequence alignment is T-Coffee, available at www.tcoffee.org, and alternatively available, e.g., from the European Bioinformatics Institute. It will also be appreciated that the final alignment used to calculate percent sequence identity can be curated either automatically or manually.

The term "domain" as used herein defined as referring to a structural part of a biomolecule that contributes to a known or suspected function of the biomolecule. Domains can be co-extensive with regions or portions thereof; domains can also incorporate a portion of a biomolecule that is distinct from a particular region, in addition to all or part of that region.

The term "biosynthetic pathway," also referred to as "metabolic pathway," refers to a set of anabolic or catabolic biochemical reactions for converting one chemical species into another. Gene products belong to the same "metabolic pathway" if they, in parallel or in series, act on the same substrate, produce the same product, or act on or produce a metabolic intermediate (i.e., a metabolite) between the same substrate and metabolite end product. The terms "engineered biosynthetic pathway," "engineered metabolic pathway," and "engineered pathway" are used interchangeably and refers to biosynthetic pathways that have been genetically modified to express or over-express endogenous polynucleotides (e.g., enzyme-encoding polynucleotides), or to express heterologous polynucleotides (e.g., enzyme-encoding polynucleotides) such as those included in a vector, or which have an alteration in expression of an endogenous gene, for example, a gene encoding for an enzyme. As used herein, the term "MMBFA producing metabolic pathway" refers to an engineered pathway which produces MMBFAs. As used herein, the term "MMBFA ester producing metabolic pathway" refers to an engineered pathway which produces MMBFA esters.

The term "substrate" or "suitable substrate" refers to any substance or compound that is converted or meant to be converted into another compound by the action of an enzyme. The term includes not only a single compound, but also combinations of compounds, such as solutions, mixtures and other materials that contain at least one substrate, or derivative thereof (for example, a combination of alcohol feedstocks to be used for the biosynthesis of wax esters). Further, the term "substrate" encompasses not only compounds that provide a carbon source suitable for use as a starting material, but also intermediate and end product metabolites used in an engineered pathway associated with a recombinant microorganism as described herein.

The term "feedstock" is defined in general as a raw material or mixture of raw materials supplied to an engineered microorganism or cell-free medium containing an engineered biosynthetic pathway from which other products can be made. In some aspects, the feedstock is provided in the cell culture medium. In some aspects, a metabolic pathway can be engineered to incorporate additional enzymes that, via substrate to product conversion, can provide a suitable feedstock to be used downstream by the engineered metabolic pathway.

The term "yield" is defined herein as the amount of product obtained per unit weight of substrate (feedstock) and can be expressed, for example, as gram of product per gram of substrate (gram/gram yield), or as percentage value of the amount of product obtained with respect to the amount of substrate supplied (% yield).

As used herein, the term "polyketide synthase" refers to a class of enzymes that are responsible for polyketide synthesis. Polyketides are a good source of hydrocarbons that can, for example, be used to produce biofuels. Polyketides can be biosynthesized through the decarboxylative condensation of malonyl-CoA by multidomain polyketide synthases, which share similarities with fatty acid synthases (FASs) (see, e.g., Peralta-Yahya et al. Nature 2012, 488:320-328). Modular type I polyketide synthases use different catalytic domains for each round of chain extension (Yuzawa et al., Curr Opin Biotechnol 2012; Menzella et al., Nat Biotechnol 2005, 23:1171-1176). Each polyketide synthase contains several modules. These modules are a set of catalytic domains that are responsible through their sequential action for one round of polyketide chain extension and sub-sequence modification of the synthesized β-ketone. A downstream module can often process non-natural intermediates from the previous module, allowing the engineering of a modular type I polyketide synthase by several means, such as (i) changing the precursor used for polyketide biosynthesis through the manipulation of the acyltransferase domains (Jacobsen et al., Science 1997, 277:367-369); (ii) altering the structure of each extension unit by domain mutation, substitution, and insertion within each module (Yuzawa et al., Curr. Opin. Biotechnol. 2012, 23:727-735); and/or (iii) changing the chain length of polyketides by module deletion, substitution, or de novo design (Menzella et al. Nat. Biotechnol. 2005, 23:1171-1176). Non-limiting examples of polyketide synthases are included in TABLE 1.

Figure 1:
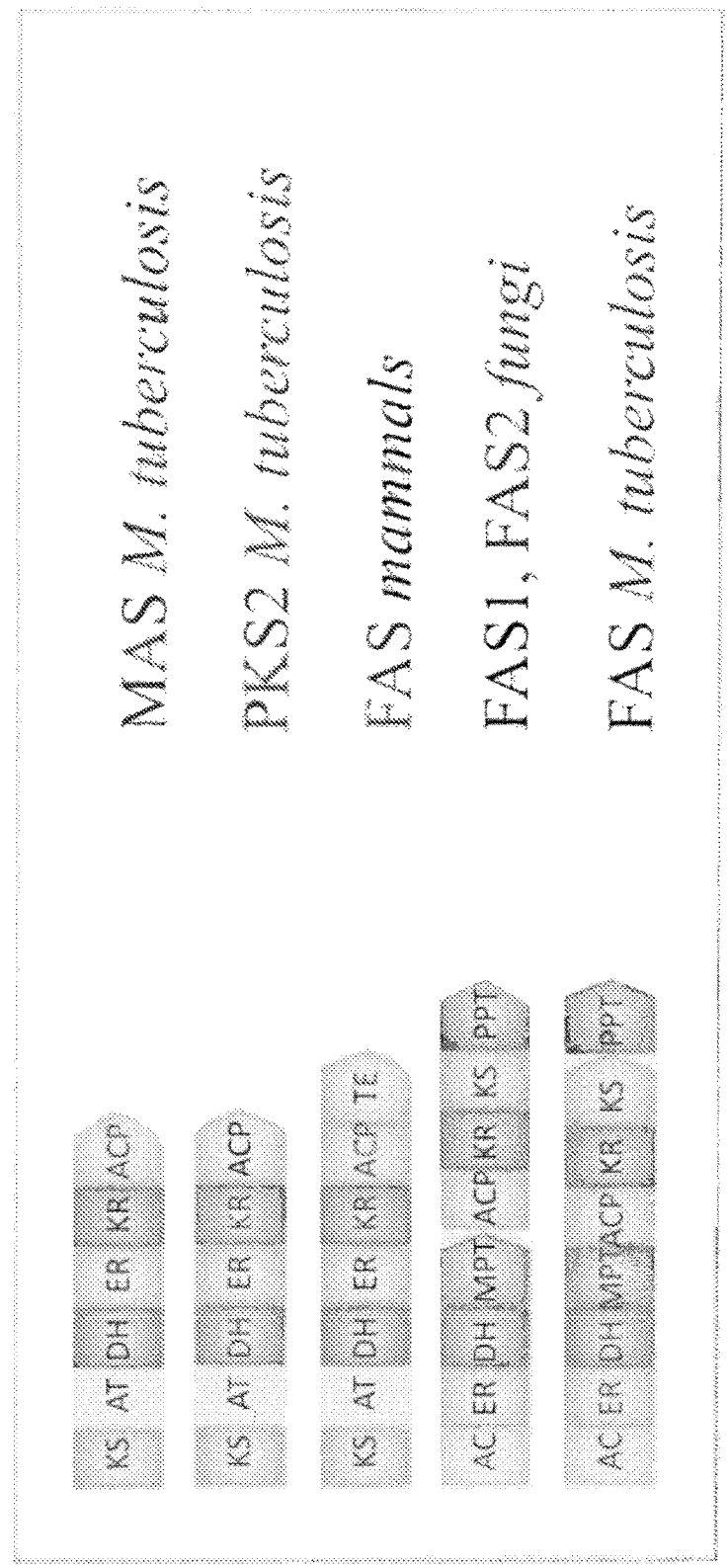

Based on their protein domain architecture, fatty acid synthases (FAS) are classified as type I or type II. Multimodular polyketide synthases (PKSs), are evolutionary descendants of type 1 FAS. The classical type I FAS is a multifunctional protein carrying all the catalytic domains on a single polypeptide chain. These enzymes are typically found in eukaryotes (Schweizer et al. Microbiol. Mol. Biol. Rev. 2004, 68:501-517) and as a remarkable prokaryotic exception in the mycolic acid-producing actinomycetes (Bloch et al., Annu. Rev. Biochem. 1977, 46:263-298), with a different domain order compared with the vertebrate FAS (Schweizer et al., Microbiol. Mol. Biol. Rev. 2004, 68:501-517) (see FIG. 1).

A large family of FAS-related enzymes have evolved by slight variations in the FAS pathways to produce a wide range of natural compounds in streptomycetes and complex lipids in mycobacteria (Gokhale et al., Curr. Opin. Struct. Biol. 2007, 17:736-743; Hertweck, Angew Chem. Int. Ed. Engl. 2009, 48:4688-4716). The common mechanisms and the structural similarity of type I FAS and PKSs resulted in the proliferation of hybrid PKS-FAS pathways (Smith et al., Science 2008, 321:1304-1305.). As an example, the very complex lipids of mycobacteria are made via a partnership between a FAS and a modular PKS (Gokhale et al. Nat. Prod. Rep. 2007, 24:267-277). In particular, the mycobacteria complex lipid PDIM (phenolphthiocerol dimycocerosate) is synthesized by the esterification of a phtiocerol or a phenolphthiocerol molecule, and a multi-methyl branched mycocerosic fatty acid synthesized by the MAS multimodular enzyme (Azad et al., Proc. Natl. Acad. Sci. USA 1996, 93:4787-4792).

Each type I polyketide-synthase module consists of several domains with defined functions, separated by short spacer regions. The order of modules and domains of a complete polyketide-synthase is as follows (in the order N-terminus to C-terminus): (i) Starting or loading module (AT-ACP-); (ii) Elongation or extending modules (-KS-AT-[DH-ER-KR]-ACP-); and (iii) Termination or releasing module (-TE). The domains in the previous schematic representations are:

AT: Acyltransferase

ACP: Acyl carrier protein with an SH group on the cofactor, a serine-attached 4'-phosphopantetheine KS: Ketosynthase with an SH group on a cysteine side-chain
KR: Ketoreductase
DH: Dehydratase
ER: Enoylreductase
TE: Thioesterase As used herein, the term "MAS" refers to mycocerosic acid synthase from *Mycobacterium tuberculosis* (see FIG. 1). MAS possesses all three auxiliary domains (KR, DH and ER) necessary for the complete reduction of newly-generated β-carbonyl acyl chain. MAS carries out the iterative condensation of medium- to long-chain fatty acyl CoA starters with methylmalonyl-CoA extender units to yield multi-branched fatty acids (Mathur et al. J. Biol. Chem. 1992, 267:19388-19395; Onwueme et al. Proc. Natl. Acad. Sci. USA 2004, 101:4608-4613; Trivedi et al. Mol. Cell 2005, 17:631-643). Medium- or long-chain fatty acids are loaded to the MAS enzyme by the FADD28 enzyme (now called FAAL 28) which are then extended with methylmalonyl-CoA units generated by an acyl-CoA carboxylase complex (Gago et al. J. Bacteriol. 2006, 188:477-486; Diacovich et al., J. Biol. Chem. 2002, 277:31228-31236; Rodriguez et al. Appl. Environ. Microbiol. 2001, 67:4166-4176). In *M. tuberculosis*, a polyketide-associated protein A5 (PAPA5) interacts with MAS and brings about transesterification of mycocerosic acids onto the diol component of phthiocerol/phenolphthtiocerol (Mathur et al. J Biol Chem 1992, 267:19388-19395; Onwueme et al. Proc Natl Acad Sci USA 2004, 101:4608-4613; Trivedi et al. Mol Cell 2005, 17:631-643).

In addition to MAS, another example of a mycobacterial PKS that catalyzes the biosynthesis of long-chain branched fatty acids by iterative utilization of methylmalonyl-CoA is PKS2. These fatty acids are named phthioceranic acids, and differ from mycocerosic acids in having an absolute configuration of S— for the methyl-branched carbon, as compared to R— in the case of mycocerosic acids.

The present inventors have found that the expression of MAS (or another suitable polyketide synthase such as PKS2 or a type I FAS) together with suitable partners enzymes, e.g., FAAL28 and PAPA5, provides the essential set of enzyme activities to reconstruct a metabolic pathway capable of synthesizing multi methyl-branched fatty acids (MMBFAs) and products derived from them, for example, MMBFA esters (wax esters), acylglycerols, and fatty alcohols. The engineered metabolic pathways disclosed herein can be expressed, for example, in a heterologous engineered microorganism (host) provided that: (1) the heterologous enzymes are active in the new environment; (2) the starters and the extender units of MAS (or another suitable polyketide synthase such as PKS2 or a type I FAS), are being synthesized in the heterologous host; and, (3) for the production of esters, the PAPA5 enzyme (or another suitable related enzyme) has a relaxed substrate specificity as to recognize different feedstocks, e.g., alcohols, that can be produced endogenously by the host or be supplied in the growth medium. These engineered biosynthetic pathways can provide useful molecules to be used, for example, as biofuels, lubricants, or for medical or cosmetic uses. These engineered pathways can be modified, for example, by replacing the MAS enzyme with suitable homologues (e.g., the PKS enzymes disclosed in TABLE 1 or suitable type I FAS enzymes) with different properties, or by modifying the MAS enzyme in order to alter the specificity for the starter unit that loads the enzyme. Furthermore, the engineered pathways disclosed herein can be modified by selecting appropriate FAAL enzymes and downstream enzymes capable of modifying the MMBFA product, such as esterases with relaxed substrate specificity. The disclosed engineered pathways can be expressed in different host systems (e.g., actinomycete bacteria like *Streptomyces*, *Mycobacterium* and *Rhodococcus*). In these organisms, the engineered metabolic pathways disclosed herein can be used to synthesize multiples end-products such as multimethyl-branched fatty acids (MMBFAs), multimethyl-branched fatty acid esters, acylglycerides (e.g., monoacylglycerides, diacylglycerides or triacylglycerides) containing at least one MMBFA, alcohols derived from MMBFAs (fatty alcohols), or combinations thereof. In this respect, it is understood that multiple engineered metabolic pathways can be expressed in a single host in order to produce a variety of products in such host, or multiple engineered pathways can be expressed in a several hosts (one or more engineered pathways per host) that are then co-cultured in order to obtain a mixture of products.

Accordingly, the present disclosure provides an engineered microorganism comprising (i) an exogenous or overexpressed polyketide synthase or active fragment thereof and (ii) an exogenous or overexpressed long chain fatty acid AMP ligase, wherein said recombinant microorganism comprises a MMBFA synthesis pathway in which the exogenous or overexpressed polyketide synthase MAS catalyzes the iterative conversion of methyl-malonyl-CoA to MMBFA. In some aspects, the polyketide synthase is a MAS (mycocerosic acid synthase) from bacteria from the genus *Mycobacterium*, for example, *M. tuberculosis* or an active fragment, variant, mutant or derivative thereof comprising an acyl transferase (AT) domain, an acyl carrier protein (ACP) domain, and a ketide synthase (KS) domain. In some aspects, the polyketide synthase or active fragment, variant, mutant or derivative thereof comprises the AT domain of MAS (SEQ ID NO:1), or a homolog, fragment, or variant thereof. In yet other aspects, the polyketide synthase further comprises at least a beta-ketoacyl synthase (KS) domain, a dehydratase (DH) domain, an enoyl reductase (ER) domain, a beta-ketoreductase (KR) domain, or a combination thereof.

In other aspects, the polyketide synthase or active fragment, variant, mutant or derivative thereof comprises an amino acid sequence having at least 40%, 45%, 50%, 55%, 60%, 65%, 70%, 75%, 80%, 85%, 90%, 95%, 98%, or 99% sequence identity to the sequence of MAS from *Mycobacterium tuberculosis* (SEQ ID NO:3). In other aspects, the polyketide synthase consists of MAS from *Mycobacterium tuberculosis* (SEQ ID NO:3). In some aspects, the MAS is a full length MAS.

In other aspects, MAS is derived from bacteria from the genus *Mycobacterium*, for example, *M. tuberculosis*. However, in some aspects, MAS can replaced in the engineered microorganism with a homologous enzyme, for example an orthologous or paralogous polyketide synthase. In some aspects, MAS can be replaced by at least one of the proteins encoded, for example, by the genes pks2 (RV3825c), pks3/4 (Rv1180/Rv1181), pks5 (RV1527), pks6 (Rv0405), pks7 (Rv1651), pks8/17 (Rv1662/3), pks9 (Rv1664), pks10 (Rv1660), pks11 (Rv1565), pks12 (Rv2048c), pks13 (Rv3800c), pks15/1 (Rv2947c/Rv2946c), or pks18 (Rv1372) from *Mycobacterium tuberculosis*. In some aspects, the polyketide synthase or active fragment, variant, mutant or derivative thereof comprises an amino acid sequence having at least 40%, 45%, 50%, 55%, 60%, 65%, 70%, 75%, 80%, 85%, 90%, 95%, 98%, or 99% sequence identity to PKS2 (SEQ ID NO:15), PKS3 (SEQ ID NO:30), PKS4 (SEQ ID NO:26), PKS5 (SEQ ID NO:37), PKS7 (SEQ ID NO:48), or PKS12 (SEQ ID NO:61) from *Myco*- bacterium tuberculosis. In some aspects, the polyketide synthase or an active fragment, variant, mutant or derivative thereof consists of PKS2 (SEQ ID NO:15), PKS3 (SEQ ID NO:30), PKS4 (SEQ ID NO:26), PKS5 (SEQ ID NO:37), PKS7 (SEQ ID NO:48), or PKS12 (SEQ ID NO:61) from *Mycobacterium tuberculosis*.

In some specific aspects the substrate specificity of the MAS enzyme can be modified by mutating amino acids responsible for substrate recognition in the active site of the AT domain of MAS.

In some aspects, specific amino acids in the active site of the AT of MAS (or another suitable polyketide synthase such as PKS2 or a type I FAS) can be mutated in order to alter its substrate specificity. The α-carbon side-chain on a polyketide or fatty acid can be changed by replacing the AT domain of the polyketide synthase, e.g., MAS, with a heterologous AT domain having a different substrate specificity. For example, the methylmalonyl-CoA-specific AT domain of MAS can be replaced by AT domains from other PKSI or PKSIII enzymes specific for other substrates such as ethylmalonyl-CoA or methoxymalonyl-ACP (Kato et al. J. Am. Chem. Soc. 2002, 124, 5268-5269; Stassi et al. Proc. Natl. Acad. Sci. USA 1998; 97:9305-9309). Non limiting examples of ethylmalonyl-CoA specific AT domains that could be used to replace the AT domain of MAS are the AT4 domain from 6-deoxyerythronolide B polyketide synthase and the AT domain from the spiramycin gene cluster (Reeves et al., Biochemistry. 2001, 40:15464-70), the AT5 domain from the niddamycin gene cluster (Stassi et al. Proc. Natl. Acad. Sci. USA 1998; 97:9305-9309), the AT5 from the tylosin gene cluster (Reeves et al. Chem Biol. 2004 10:1465-72), the AT4 domain from the Ascomycin gene cluster (Yadav et al., J. Mol. Biol. 2003, 328:335-63) and the AT4 domain of the FK506 (Mo et al., J. Am. Chem. Soc. 2011,133:976-85). In addition to AT domain replacement, specificity can be changed by mutating the sequence of the third conserved motif present in the AT active site (from amino acid positions 724 to 727) (Reeves et al., Biochemistry. 2001, 40:15464-70).

Also, the KS domain of MAS from *M. tuberculosis* (amino acid positions 7 to 430) can be replaced by the corresponding KS domain of a paralog, for example, the KS domain of PKS2, PKS3/4, PKS5, PKS7, or PKS12, in order to change the specificity for the acyl-AMP used as a substrate. This engineered MAS would be loaded by the FADD known in the art to interact with the KS domain of the PKS used to select the substitute KS domain. Accordingly, one skilled in the art would understand that when a metabolic pathway is engineered using a MAS or related enzyme in which the KS domain has been replaced, the engineered biosynthetic pathway will also contain a long chain fatty acid AMP ligase (e.g., a FADD enzyme) capable of interacting with the substitute KS domain.

In some aspects, the long-chain fatty acid AMP ligase in the engineered microorganism is the mycobacterial fatty-acid-AMP ligase FADD28 (fatty-acid-AMP synthetase) or an active fragment, variant, mutant, or derivative thereof. In some aspects, the FADD28 is derived from a mycobacteria, for example, *Mycobacterium tuberculosis*. In some aspects, long-chain fatty acid AMP ligase can replaced in the engineered microorganism with a homologous enzyme, for example an orthologous or paralogous long-chain fatty acid AMP ligase. In some aspects, the long chain fatty acid AMP ligase comprises SEQ ID NO:72, or a homolog, active fragment, variant, mutant, or derivative thereof. In other aspects, the long chain fatty acid AMP ligase or homolog, active fragment, variant, mutant, or derivative thereof comprises an amino acid sequence having at least 40%, 45%, 50%, 55%, 60%, 65%, 70%, 75%, 80%, 85%, 90%, 95%, 98%, or 99% sequence identity to SEQ ID NO:72. In some aspects, the long chain fatty acid AMP ligase consists of SEQ ID NO:72. In other aspects, the long chain fatty acid AMP ligase comprises an amino acid sequence having at least at least 40%, 45%, 50%, 55%, 60%, 65%, 70%, 75%, 80%, 85%, 90%, 95%, 98%, or 99% sequence identity to FADD21 (SEQ ID NO:72), FADD23 (SEQ ID NO:74), or FADD24 (SEQ ID NO:75) from *Mycobacterium tuberculosis*. In other aspects, the long chain fatty acid AMP ligase consists of FADD21 (SEQ ID NO:72), FADD23 (SEQ ID NO:74), or FADD24 (SEQ ID NO:75) from *Mycobacterium tuberculosis*.

In some aspects, the engineered microorganism further comprises an exogenous or overexpressed ester synthase, wherein said ester synthase catalyzes the transesterification of an MMBFA covalently bound to the ACP domain of MAS (or another suitable polyketide synthase such as PKS2 or a type I FAS) with an acceptor alcohol to produce an MMBFA ester. In some aspects, the ester synthase is a mycobacterial PAPA5 or a homolog, active fragment, variant, mutant, or derivative thereof. In some aspects, ester synthase can replaced in the engineered microorganism with a homologous enzyme, for example an orthologous or paralogous ester synthase. In other aspects, the ester synthase comprises SEQ ID NO:76, or a homolog, active fragment, variant, mutant or derivative thereof. In some aspects, the ester synthase comprises an amino acid sequence having at least 40%, 45%, 50%, 55%, 60%, 65%, 70%, 75%, 80%, 85%, 90%, 95%, 98%, or 99% sequence identity to SEQ ID NO:76. In other aspects, the PAPA5 is derived from *Mycobacterium tuberculosis*. In some aspects, the ester synthase comprises an amino acid sequence having at least 40%, 45%, 50%, 55%, 60%, 65%, 70%, 75%, 80%, 85%, 90%, 95%, 98%, or 99% sequence identity to PAPA1 (SEQ ID NO:78), PAPA3 (SEQ ID NO:77), or PAPA4 (SEQ ID NO:79) from *Mycobacterium tuberculosis*. In some aspects, the ester synthase consists of PAPA1 (SEQ ID NO:78), PAPA3 (SEQ ID NO:77), or PAPA4 (SEQ ID NO:79) from *Mycobacterium tuberculosis*.

In other aspects, the MMBFA synthesis pathway in the engineered microorganism further comprises additional substrate to product conversions providing feedstocks for the engineered pathway(s) leading to the biosynthesis of MMBFAs, their esters, derived acylglycerides, derived alcohols, or combinations thereof. Accordingly, in some aspects, the MMBFA synthesis pathway in the engineered microorganism further comprises the propionate to propionyl-CoA, propionyl-CoA to methylmalonyl-CoA, or acyl-acyl carrier protein to fatty acid substrate to product conversions, or combinations thereof.

In some aspects, the enzyme that catalyzes the conversion of propionate to propionyl-CoA is a propionyl-CoA synthetase. This enzyme can be a propionyl-CoA synthetase or homolog, active fragment, variant, mutant, or derivative thereof. In some aspects, the propionyl-CoA synthetase is PRPE, for example, a PRPE derived from *E. coli*. In some aspects, the propionyl-CoA synthetase comprises SEQ ID NO:80, or a homolog, active fragment, variant, mutant, or derivative thereof. In other aspects, the propionyl-CoA synthetase comprises an amino acid sequence having at least 40%, 45%, 50%, 55%, 60%, 65%, 70%, 75%, 80%, 85%, 90%, 95%, 98%, or 99% sequence identity to SEQ ID NO:80. In other aspects, the propionyl-CoA synthetase consists of SEQ ID NO:80.

In other aspects, the enzyme that catalyzes the conversion of propionyl-CoA to methylmalonyl-CoA is an exogenous or overexpressed propionyl-CoA carboxylase (PCC) complex. In some aspects, the propionyl-CoA carboxylase (PCC) complex comprises SEQ ID NO:81, or a homolog, active fragment, variant, mutant, or derivative thereof; and/or SEQ ID NO:82, or a homolog, active fragment, variant, mutant, or derivative thereof; and/or, SEQ ID NO:83, or a homolog, active fragment, variant, mutant, or derivative thereof; and/or SEQ ID NO:84, or a homolog, active fragment, variant, mutant, or derivative thereof. In some aspects, the propionyl-CoA carboxylase (PCC) complex comprises an amino acid sequence having at least 40%, 45%, 50%, 55%, 60/o, 65%, 70%, 75%, 80%, 85%, 90%, 95%, 98%, or 99% sequence identity to any one of SEQ ID NO:81, SEQ ID NO:82, SEQ ID NO:83, or SEQ ID NO:84.

In some aspects, the PCC complex is derived from bacteria, for example, from bacteria from the genera *Streptomyces, Mycobacterium, Rhodococcus, Nocardia, Pseudomonas, Corynebacterium, Acinetobacter, Brucella,* or *Burkholderia* In other aspects, the PCC complex is derived, for example, from *Mycobacterium smegmatis, Homo sapiens, Acinetobacter baumannii, Brucella suis, Burkholderia glumae, Saccharospora erythraea,* and *Aedes aegypti.* In specific aspects, the PCC complex is derived, for example, from *Streptomyces coelicolor.* In some aspects, the PCC complex comprises the ACCA1 (SEQ ID NO:82), PCCB (SEQ ID NO:83), and PCCE (SEQ ID NO:84) proteins from *Streptomyces coelicolor* or homologs, active fragments, variants, mutants, or derivatives thereof. In some aspects, the propionyl-CoA carboxylase (PCC) complex consists of SEQ ID NO:82, SEQ ID NO:83, and SEQ ID NO:84.

Additional, non-limiting examples of polypeptides that can catalyze the conversion of propionyl-CoA to methylmalomyl-CoA are the propionyl-CoA carboxylases from *Ehrlichia chaffeensis* (Genbank: YP_507303 and YP_507410), *Agrobacterium vitis* (Genbank: YP_002547482 and YP_002547479), *Methylobacterium extorquens* (Genbank: YP_003069256 and YP_003065890), *Sinorhizobium meliloti* (Genbank: NP_437988 and NP_437987), or *Ruegeria pomeroyi* (Genbank: YP_166352 and YP_166345).

In some aspects, the MMBFA synthesis pathway in the engineered microorganism further comprises a methylmalonate to methylmalonyl-CoA substrate to product conversion. The enzyme that catalyzes the conversion of methylmalonate to methylmalonyl-CoA can be an exogenous or overexpressed malonyl/methylmalonyl-CoA ligase. In some aspects, the malonyl/methylmalonyl-CoA ligase is derived from bacteria, for example, from *Streptomyces coelicolor.* In some aspects, the malonyl/methylmalonyl-CoA ligase comprises SEQ ID NO:85, or a homolog, active fragment, variant, mutant, or derivative thereof. In some aspects, the malonyl/methylmalonyl-CoA ligase comprises an amino acid sequence having at least 40%, 45%, 50%, 55%, 60%, 65%, 70%, 75%, 80%, 85%, 90%, 95%, 98%, or 99% sequence identity to SEQ ID NO:85. In some aspects, the malonyl/methylmalonyl-CoA ligase consists of SEQ ID NO:85.

In some aspects, the MMBFA engineered biosynthetic pathway further comprises a succinyl-CoA to methylmalonyl-CoA substrate to product conversion. The enzyme that catalyzes the conversion of succinyl-CoA to methylmalonyl-CoA can be an exogenous or overexpressed methylmalonyl-CoA mutase/epimerase. In some aspects, the methylmalonyl-CoA mutase/epimerase is derived from bacteria, for example, from *Propionibacterium freudenreichii* subsp. *shermanii.* In other aspects, the methylmalonyl-CoA mutase/epimerase comprises SEQ ID NO:86, or a homolog, active fragment, variant, mutant, or derivative thereof; and/or SEQ ID NO:87, or a homolog, active fragment, variant, mutant, or derivative thereof; and/or SEQ ID NO:88, or a homolog, active fragment, variant, mutant, or derivative thereof. In some aspects, the methylmalonyl-CoA mutase/epimerase comprises an amino acid sequence having at least 40%, 45%, 50%, 55%, 60%, 65%, 70%, 75%, 80%, 85%, 90%, 95%, 98%, or 99% sequence identity to any one of SEQ ID NO:86, SEQ ID NO:87, or SEQ ID NO:88. In some aspects, the methylmalonyl-CoA mutase/epimerase consists of SEQ ID NO:86, SEQ ID NO:87, and SEQ ID NO:88.

Exemplary methylmalonyl-CoA mutases include, but are not limited to SBM from *E. coli,* MUTA and/or MUTB from *Streptomyces cinnamonensis,* and methylmalonyl-CoA mutases from *Janibacter* sp. HTCC2649, *Corynebacterium glutamicum, Euglena gracilis, Homo sapiens, Bacillus megaterium,* and *Mycobacterium smegmatis, Rhodococcus erythropolis,* or *Porphyromonas gingivalis.* Methylmalonyl-CoA epimerases suitable for use in the engineered microorganisms disclosed herein are *Sorangium cellulosum* So ce 56 methylmalonyl-CoA epimerase, *Streptomyces sviceus* ATCC 29083 methylmalonyl-CoA epimerase, *Kribbella flavida* DSM 17836 methylmalonyl-CoA epimerase, and methylmalonyl-CoA epimerases from *Homo sapiens, Bacillus megaterium,* and *Mycobacterium smegmatis.*

In other aspects, the MMBFA synthesis pathway in the engineered microorganism further comprises an exogenous or overexpressed acyl-acyl carrier protein (ACP) thioesterase that catalyzes the conversion of acyl-acyl carrier protein to fatty acid. In some aspects, the thioesterase is the TESA' protein from *E. coli.* The TESA' protein is derived from the product from the tesA gene, except that it lacks a signal sequence. Accordingly, the TESA' gene product remains in the cytoplasm of the host cell. In some aspects, the thioesterase comprises SEQ ID NO:89, or a homolog, active fragment, variant, mutant, or derivative thereof. In some aspects, the thioesterase comprises an amino acid sequence having at least 40%, 45%, 50%, 55%, 60%, 65%, 70%, 75%, 80%, 85%, 90%, 95%, 98%, or 99% sequence identity to SEQ ID NO:89. In some aspects, the thioesterase consists of SEQ ID NO:89.

In other aspects, the MMBFA engineered biosynthetic pathway in the engineered microorganism further comprises an exogenous or overexpressed phosphopantetheinyl transferase. In some aspects, the 4'-phosphopantetheinyl transferase is an Sft-type 4'-phosphopantetheinyl transferase. In some aspects, the Sfp-type 4'-phosphopantetheinyl transferase is derived from bacteria, for example, from *Bacillus subtilis.* In some aspects, the phosphopantetheinyl transferase comprises SEQ ID NO:90, or a homolog, active fragment, variant, mutant, or derivative thereof. In other aspects, the phosphopantetheinyl transferase comprises an amino acid sequence having at least 40%, 45%, 50%, 55%, 60%, 65%, 70%, 75%, 80%, 85%, 90%, 95%, 98%, or 99% sequence identity to SEQ ID NO:90. In still other aspects, the 4'-phosphopantetheinyl transferase gene replaces a genetic locus responsible for propionate catabolism in said microorganism. In other aspects, the phosphopantetheinyl transferase consists of SEQ ID NO:90.

The present disclosure also provides an engineered microorganism comprising
a MAS polyketide synthase from *Mycobacterium tuberculosis* (SEQ ID NO:3);

a FADD28 long chain fatty acid AMP ligase from *Mycobacterium tuberculosis* (SEQ ID NO:72);
a TESA' thioesterase from *Escherichia coli* (SEQ ID NO:89); and,
(iv) a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor,*
wherein the MAS polyketide synthase catalyzes the iterative conversion of methyl-malonyl-CoA to MMBFA.

In some aspects, the engineered microorganism further comprises a PAPA5 ester synthase from *Mycobacterium tuberculosis* (SEQ ID NO:76), wherein the ester synthase catalyzes the transesterification of an MMBFA with an acceptor alcohol to produce an MMBFA ester.

Also provided in the present disclosure is an engineered microorganism comprising
a PKS3/4 polyketide synthase from *Mycobacterium tuberculosis* (SEQ ID NO:26);
a FADD21 long chain fatty acid AMP ligase from *Mycobacterium tuberculosis* (SEQ ID NO:73);
a TESA' thioesterase from *Escherichia coli* (SEQ ID NO:89); and,
a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor,*
wherein the PKS3/4 polyketide synthase catalyzes the iterative conversion of methyl-malonyl-CoA to MMBFA.

In some aspects, the engineered microorganism further comprises a PAPA3 ester synthase from *Mycobacterium tuberculosis* (SEQ ID NO:77), wherein the ester synthase catalyzes the transesterification of an MMBFA with an acceptor alcohol to produce an MMBFA ester.

The instant disclosure also provides an engineered microorganism comprising
a PKS2 polyketide synthase from *Mycobacterium tuberculosis* (SEQ ID NO:15);
a FADD23 long chain fatty acid AMP ligase from *Mycobacterium tuberculosis* (SEQ ID NO:74);
a TESA' thioesterase from *Escherichia coli* (SEQ ID NO:89); and,
a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor,*
wherein the PKS2 polyketide synthase catalyzes the iterative conversion of methyl-malonyl-CoA to MMBFA.

In some aspects, the engineered microorganism further comprises a PAPA1 ester synthase from *Mycobacterium tuberculosis* (SEQ ID NO:78), wherein the ester synthase catalyzes the transesterification of an MMBFA with an acceptor alcohol to produce an MMBFA ester.

The instant disclosure also provides an engineered microorganism comprising
a PKS5 polyketide synthase from *Mycobacterium tuberculosis* (SEQ ID NO:37);
a FADD24 long chain fatty acid AMP ligase from *Mycobacterium tuberculosis* (SEQ ID NO:75);
a TESA' thioesterase from *Escherichia coli* (SEQ ID NO:89); and,
a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor,*
wherein the PKS5 polyketide synthase catalyzes the iterative conversion of methyl-malonyl-CoA to MMBFA.

In some aspects, the engineered microorganism further comprises a PAPA4 ester synthase from *Mycobacterium tuberculosis* (SEQ ID NO:79), wherein the ester synthase catalyzes the transesterification of an MMBFA with an acceptor alcohol to produce an MMBFA ester.

In some aspects, the engineered microorganism is selected from the group consisting of bacteria, fungi, yeast, and algae. See, e.g., U.S. Pat. No. 8,071,358; EP 2297286; WO 2011/088088 for suitable organisms. In some aspects, the engineered microorganism is a bacterium selected, for example, from the genera *Streptomyces, Rhodococcus, Mycobacterium, Escherichia, Corynebacteriuwn, Pseudomonas, Nocardia,* or *Bacillus.* In specific aspects, the bacteria is, for example, *Escherichia coli, Streptomyces coelicolor,* or *Rhodococcus opacus.*

In some aspects, the engineered microorganism is a fungus, in particular a yeast selected from the genera *Saccharomyces, Kluyveromyces, Pachysolen, Zygosaccharomyces, Debaryomyces, Pichia, Schizosaccharomyces, Candida, Issatchenkia, Hansenula, Yarrowia, Tricosporon, Rhodotorula,* or *Myxozyma.* In specific other aspects, the yeast can be, for example, *Saccharomyces cerevisiae, Saccharomyces uvarum, Saccharomyces bayanus, Saccharomyces paradoxus, Saccharomyces castefi, Saccharomyces kluyveri, Kluyveromyces thermotolerans, Kluyveromyces lactis, Kluyveromyces marxianus, Kluyveromyces waltii, Pachysolen tannophilis, Zygosaccharomyces baiff, Zygosaccharomyces rouxii, Debaryomyces hansenii, Debaromyces carsonii, Pichiapastorius, Pichia anomala, Pichia stipitis, Pichia castillae, Schizosaccharomyces pombe, Candida utilis, Candida glabrata, Candida tropicalis, Candida xestobii, Issatchenkia orientalis, Issatchenkia occidentalis, Issatchenkia scutulata, Hansenula anomala,* or *Yarrowia lipolytica.*

In some aspects, the engineered microorganism is a filamentous fungus, for example from the genera *Trichoderma, Aspergillus, Fusarium, Humwnicola, Rhizomucor, Mucor, Neurospora, Myceliophtora, Penicillium, Phanerochaete, Pleurotus,* or *Trametes.* In specific other aspects, the filamentous fungus can be, for example, *Trichoderma koningii, Trichoderma viride, Trichoderma reesei, Trichoderma longibrachiatur Aspergillus awamorfi, Aspergillus fumigatis, Aspergillus foetidus, Aspergillus nidulans, Aspergillus niger, Aspergillus oryzae, Humicola insolens, Humicula lanuginosa, Rhizomucor miehei,* or *Mucor michei.*

In some aspects, the engineered microorganism is an algae selected, for example, from the genera Monalanthus, *Botryococcus, Chlorella Outirococcus, Scenedesmus, Nannochloris, Dunaliella, Navicula, Radiosphaera, Biddulphia, Nitzschia, Ochromonas, Peridinium, Neochloris, Oocystis, Chrysochromulina, Prymnesium, Scotiella, Euglena, Porphyridium, Tetraselmis,* or *Chlamydomonas.* In specific aspects, the algae is, for example, *Monalanthus salina, Botryococcus braunii, Chlorella prototecoides, Scenedesmus obliquus, Dunaliella bardawil, Navicula pelliculosa, Radiosphaera negevensis, Biddulphia aurita, Chlorella vulgaris, Nitzschia palea, Ochromonas dannica, Chrorella pyrenoidosa, Peridinium cinctum, Neochloris oleabundans, Oocystis polymorpha, Scenedesmus acutus, Chlorella minutissima, Prymnesium parvum, Navicula pelliculosa, Scenedesmus dimorphus, Euglena gracilis,* or *Porphyridium cruentum.*

In some aspects, the MMBFA produced by the engineered microorganism has a fatty acid chain length of about 10 to about 40 carbons, and at least one branching at an even-numbered position carbon (see FIG. 2). In some aspects, the fatty chain length has 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 carbons. In some aspects, the fatty acid chain is longer than 40 carbons. In other aspects, the MMBFA comprises at least one methyl branch. In some aspects, the MMBFA comprises 2 to four methyl branches located at even-numbered carbon positions, for example, at any one of carbons 2, 4, 6, or 8 of the fatty acid chain. In some aspects, the MMBFA comprises at least 2, 3, 4, 5, 6, 7, 8, 9, or 10 methyl branches. In other aspects, the MMBFA comprises more than 10 methyl branches. In some aspects, the methyl branches are located at consecutive even-numbered carbon positions. In some aspects, the methyl branches are located at non-consecutive even-numbered carbon positions.

In some aspects, the MMBFA comprises at least one unsaturation. In some aspects, the at least one unsaturation is located between carbons 17 and 18 of the fatty acid chain. In some aspects, the MMBFA comprises at least 2, 3, 4 or 5 unsaturations. In some aspects, the MMBFA comprises more than 5 unsaturations.

It will be understood by one of ordinary skill in the art, that the MMBFA characteristics above described apply to free MMBFA as well as derivatives comprising those MMBFAs, for example, MMBFA esters (wax esters; see FIG. 2), acylglycerides (e.g., monoacylglycerides, diacylglycerides, or triacylglycerides), alcohols (fatty alcohols), or combinations thereof.

In one aspect, the total fatty acids produced by the engineered microorganism disclosed herein comprise from about 30% to about 100% MMBFA. For example, the total fatty acids produced by the engineered microorganism disclosed herein comprise about 30%, about 35%, about 40%, about 45%, about 50%, about 55%, about 60%, about 65%, about 70%, about 75%, about 80%, about 85%, about 95%, or about 99% MMBFA. Of the MMBFAs produced by the engineered microorganism, approximately 1% to approximately 95% or more (e.g., approximately 5%, 10%, 15%, 20%, 25%, 30%, 35%, 40%, 45%, 50%, 55%, 60%, 65%, 70%, 75%, 80%, 85%, 90%, 95%, or 100%) is an MMBFA comprising a methyl group on one or more even-numbered carbons. In some aspects, the cell does not produce, or produces only trace amounts of, MMBFAs comprising methyl branching at odd-numbered carbons. By "trace amount" is meant less than 1% of the total fatty acid content produced by the host cell.

In one aspect, the total fatty acid esters produced by the engineered microorganism disclosed herein comprise from about 30% to about 100% MMBFA esters. For example, the total fatty acid esters produced by the engineered microorganism disclosed herein comprise about 30%, about 35%, about 40%, about 45%, about 50%, about 55%, about 60%, about 65%, about 70%, about 75%, about 80%, about 85%, about 95%, or about 99% MMBFA esters. Of the MMBFA esters produced by the engineered microorganism, approximately 1% to approximately 95% or more (e.g., approximately 5%, 10%, 15%, 20%, 25%, 30%, 35%, 40%, 45%, 50%, 55%, 60%, 65%, 70%, 75%, 80%, 85%, 90%, 95%, or 100%) is an MMBFA ester comprising a methyl group on one or more even-numbered carbons. In some aspects, the cell does not produce, or produces only trace amounts of, MMBFA esters comprising methyl branching at odd-numbered carbons.

In certain aspects, the engineered cells tolerate large amounts of MMBFAs (or their products such as MMBFA esters, acylglycerides containing MMBFAs, and alcohols derived from MMBFAs) in the growth medium, plasma membrane, or lipid droplets, and/or produce MMBFAs (or their products such as MMBFA esters, acylglycerides containing MMBFAs, and alcohols derived from MMBFAs) more economically that non-engineered cells by, for example, using a less expensive feedstock, requiring less fermentation time, and the like.

In some aspects, the engineered microorganism produces an MMBFA ester using an alcohol as the acceptor. This acceptor alcohol can be, for example, a primary alcohol, a secondary alcohol, a tertiary alcohol, or a combination thereof. In some aspects, the acceptor alcohol is a linear alcohol or a branched alcohol. In other aspects, the acceptor alcohol is a neo-alcohol. In some aspects, the acceptor alcohol is a monovalent alcohol, a divalent alcohol, or a combination thereof.

In some aspects, the monovalent alcohol is, for example, ethanol, 1-butanol, 1-pentanol), 2-propanol, 2-butanol, 1-octanol, (+/−) 2-octanol, (R)-(−)-2-octanol, 1-nonanol, 1-decanol, (+/−) 2-undecanol, myristyl alcohol (1-tetradecanol), palmityl alcohol (1-hexadecanol), stearyl alcohol (1-octadecanol), 1-eicosanol, trans-2-octene-1-ol, DL-3-OH-methyl palmitate, or a combination thereof.

In some aspects, the divalent alcohol is, for example, (S)-(−)-1,2-decanediol, (R)-1,2-decanediol, (+/−) 1,2-octanediol, or a combination thereof. In some aspects, the neo-alcohol is, for example, trimethylpropane, pentaerythrite, neopentylclycol, or a combination thereof. In certain aspects, the MMBFA ester product has an ester chain length of about 2 to about 24 carbons. For example, MMBFA ester products can have an ester chain length of 2, 3, 4, 5, 6, 7, 8, 9, 10, 11, 12, 13, 14, 15, 16, 17, 18, 19, 20, 21, 22, 23, 24, or 25 carbons. In some aspects, the MMBFA ester products can have an ester chain length of more that 25 carbons.

In some aspects, the MMBFA ester product of an engineered microorganism disclosed herein comprises, for example, octyl 2,4,6,8-tetramethyltetracosanoate; (Z)-octyl 2,4,6,8-tetramethylhexacos-17-enoate; (Z)-octyl 2,4,6,8-tetramethyltetracos-17-enoate; octyl 2,4,6,8-tetramethyltriacontonoate; ethyl 2,4,6,8-tetramethyltetracosanoate; (Z)-ethyl 2,4,6,8-tetramethylhexacos-17-enoate; (Z)-ethyl 2,4,6, 8-tetramethyltetracos-17-enoate; ethyl 2,4,6,8-tetramethyltriacontanoate; pentyl 2,4,6,8-tetramethyltetracosanoate; (Z)-pentyl 2,4,6,8-tetramethylhexacos-17-enoate; (Z)-pentyl 2,4,6,8-tetramethyltetracos-17-enoate; pentyl 2,4,6,8-tetramethyltriacontonoate; butyl 2,4,6,8-tetramethyltetracosanoate; (Z)-butyl 2,4,6,8-tetramethylhexacos-17-enoate; (Z)-butyl 2,4,6,8-tetramethyltetracos-17-enoate; butyl 2,4,6,8-tetramethyltriacontonoate; or combinations thereof.

The polynucleotides encoding one or more of the polypeptides (enzymes) that catalyze the reactions in the engineered pathways and engineered microorganisms disclosed herein can be derived from any source. Depending on the aspect of the present disclosure, the polynucleotide can be isolated from a natural source such as bacteria, algae, fungi, plants, or animals; produced via a semi-synthetic route, or synthesized de novo. In some aspects, the enzyme and corresponding polynucleotides are naturally found in the host cell and overexpressed as desired. In this regard, for example, additional copies of the polynucleotide can be introduced in the host cell to increase the amount of enzyme available for MMBFA production. Overexpression of a native polynucleotide can also be achieved by upregulating endogenous promoter activity, or operably linking the polynucleotide to a more robust promoter. Exogenous enzymes and their corresponding polynucleotides are also suitable for use in the context of the present disclosure.

In certain aspects, the engineered microorganism produces a fragment, variant, mutant, or derivative of a polypeptide described herein. In certain aspects, the fragment, variant, mutant, or derivative of a polypeptide described herein retains at least some of the biological activity, e.g., catalytic activity or binding activity, of the polypeptide. In some aspects, the fragment, variant, mutant, or derivative of a polypeptide described herein retains at least about 50%, at least about 55%, at least about 60%, at least about 65%, at least about 70%, at least about 75%, at least about 80%, at least about 85%, at least about 90%, or at least about 95%, of the biological activity.

In some aspects, at least one gene encoding one of the exogenous or overexpressed enzymes in the engineered microorganism has been subjected to molecular evolution to enhance the enzymatic activity of the enzyme. In other aspects, at least one gene encoding one of the exogenous or overexpressed enzymes has been mutated to enhance the enzymatic activity of the enzyme. In some aspects, the polynucleotides encoding the enzymes disclosed herein can be codon-optimized to improve their expression in the host cell. Codon-optimized sequences, for example, generally encode the same amino acid sequence as the parent sequence but contain codons that are preferentially expressed in a particular host cell.

The engineered microorganisms disclosed herein can comprise any combination of polynucleotides described herein to produce MMBFAs and their products such as MMBFA esters, acylglycerides containing MMBFAs, alcohols derived from MMBFAs, and combinations thereof. Engineered microorganisms can be the produced in any suitable manner to establish one or more expression vectors inside a host cell. The expression vector can include the exogenous polynucleotide operably linked to expression elements, such as, for example, promoters, enhancers, ribosome binding sites, operators, and activating sequences. Such expression elements can be regulatable, for example, inducible (via the addition of an inducer such as IPTG or arabinose). Alternatively or in addition, the expression vector can include additional copies of a polynucleotide encoding a native gene product operably linked to expression elements.

Representative examples of useful promoters include, but are not limited to the LTR or SV40 promoter, the *E. coli* lac, tet, or trp promoters, the phage Lambda $P_L$ promoter, and other promoters known to control expression of genes in prokaryotic or eukaryotic cells or their viruses. In one aspect, the expression vector also includes appropriate sequences for amplifying expression. The expression vector can comprise elements to facilitate incorporation of polynucleotides into the cellular genome. Introduction of the expression vector or other polynucleotides into cells can be performed any suitable method, such as, for example, transformation, electroporation, microinjection, microprojectile bombardment, calcium phosphate precipitation, modified calcium phosphate precipitation, cationic lipid treatment, photoporation, fusion methodologies, receptor mediated transfer, or polybrene precipitation. Alternatively, the expression vector or other polynucleotides can be introduced by infection with a viral vector, by conjugation, by transduction, or by any other suitable method.

Engineered microorganisms, e.g., bacterial or fungal cells, containing the polynucleotides encoding the proteins disclosed herein can be cultured under conditions appropriate for growth of the cells and expression of the polynucleotides. Cells expressing the proteins can be identified by any suitable methods, e.g., by PCR screening, screening by Southern blot analysis, or screening for the expression of the protein. In certain aspects, cells that contain the polynucleotide(s) can be selected by including a selectable marker in the DNA construct, with subsequent culturing of cells containing a selectable marker gene under conditions appropriate for survival of only those cells that express the selectable marker gene. The introduced DNA construct can be further amplified by culturing genetically engineered cells under appropriate conditions (e.g., culturing engineered cells containing an amplifiable marker gene in the presence of a concentration of a drug at which only cells containing multiple copies of the amplifiable marker gene can survive).

Any cell culture conditions appropriate for growing a host cell and synthesizing MMBFAs and/or their products is suitable for use in the methods disclosed herein. Addition of fatty acid synthesis intermediates, precursors, and/or cofactors for the enzymes associated with the synthesis of MMBFAs and/or their products is contemplated herein. In some aspects, the engineered microorganisms (e.g., bacterial cells) have an optimal temperature for growth, for example, a lower temperature than normally encountered for growth and/or fermentation. For example, in certain aspects, incorporation of MMBFAs, MMBFA esters, acylglycerides containing MMBFAs, or alcohols derived from MMBFAs (fatty alcohols) into the membrane can cause changes in membrane fluidity, which is property normally associated with the optimal temperature for growth.

The present disclosure also provides an engineered MMBFA synthesis pathway comprising (i) an exogenous or overexpressed polyketide synthase (for example a mycobacterial MAS), and (ii) an exogenous or overexpressed long chain fatty acid AMP ligase, wherein the exogenous or overexpressed polyketide synthase catalyzes the iterative conversion of methyl-malonyl-CoA to MMBFA. The suitable enzymes and substrate to product conversions described above in reference to an engineered microorganism are equally applicable to the combination of enzymes required to catalyze the reactions used to produce MMBFAs and their products in a cell-free system.

The MMBFA producing engineered pathway can comprise the following reactions:
propionate to propionyl-CoA;
propionyl-CoA to methylmalonyl-CoA; and,
methylmalonyl-CoA and fatty acid to MMBFA.

The MMBFA ester producing engineered pathway also can comprise the following reactions:
propionate to propionyl-CoA;
propionyl-CoA to methylmalonyl-CoA;
methylmalonyl-CoA and fatty acid to MMBFA; and,
MMBFA and alcohol to MMBFA ester.

The MMBFA-derived triacylglyceride producing engineered pathway can comprise the following reactions:
propionate to propionyl-CoA;
propionyl-CoA to methylmalonyl-CoA;
methylmalonyl-CoA and fatty acid to MMBFA; and,
MMBFA and glycerol to MMBFA-derived triacylglyceride.

The present disclosure provides an engineered biosynthetic pathway comprising
a MAS polyketide synthase from *Mycobacterium tuberculosis* (SEQ ID NO:3);
a FADD28 long chain fatty acid AMP ligase from *Mycobacterium tuberculosis* (SEQ ID NO:72);
a TESA' thioesterase from *Escherichia coli* (SEQ ID NO:89); and, (iv) a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor*,
wherein the MAS polyketide synthase catalyzes the iterative conversion of methyl-malonyl-CoA to MMBFA.

In some aspects, the engineered biosynthetic pathway further comprises a PAPA5 ester synthase from *Mycobacterium tuberculosis* (SEQ ID NO:76), wherein the ester synthase catalyzes the transesterification of an MMBFA with an acceptor alcohol to produce an MMBFA ester.

Also provided in the present disclosure is an engineered biosynthetic pathway comprising a PKS3/4 polyketide synthase from *Mycobacterium tuberculosis* (SEQ ID NO:26);

a FADD21 long chain fatty acid AMP ligase from *Mycobacterium tuberculosis* (SEQ ID NO:73);

a TESA' thioesterase from *Escherichia coli* (SEQ ID NO:89); and, a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor,* wherein the PKS3/4 polyketide synthase catalyzes the iterative conversion of methyl-malonyl-CoA to MMBFA.

In some aspects, the engineered biosynthetic pathway further comprises a PAPA3 ester synthase from *Mycobacterium tuberculosis* (SEQ ID NO:77), wherein the ester synthase catalyzes the transesterification of an MMBFA with an acceptor alcohol to produce an MMBFA ester.

The instant disclosure also provides an engineered biosynthetic pathway comprising a PKS2 polyketide synthase from *Mycobacterium tuberculosis* (SEQ ID NO:15);

a FADD23 long chain fatty acid AMP ligase from *Mycobacterium tuberculosis* (SEQ ID NO:74);

a TESA' thioesterase from *Escherichia coli* (SEQ ID NO:89); and, a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor,* wherein the PKS2 polyketide synthase catalyzes the iterative conversion of methyl-malonyl-CoA to MMBFA.

In some aspects, the engineered biosynthetic pathway further comprises a PAPA1 ester synthase from *Mycobacterium tuberculosis* (SEQ ID NO:78), wherein the ester synthase catalyzes the transesterification of an MMBFA with an acceptor alcohol to produce an MMBFA ester.

The instant disclosure also provides an engineered biosynthetic pathway comprising a PKS5 polyketide synthase from *Mycobacterium tuberculosis* (SEQ ID NO:37);

a FADD24 long chain fatty acid AMP ligase from *Mycobacterium tuberculosis* (SEQ ID NO:75);

a TESA' thioesterase from *Escherichia coli* (SEQ ID NO:89); and, a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor,* wherein the PKS5 polyketide synthase catalyzes the iterative conversion of methyl-malonyl-CoA to MMBFA.

In some aspects, the engineered biosynthetic pathway further comprises a PAPA4 ester synthase from *Mycobacterium tuberculosis* (SEQ ID NO:79), wherein the ester synthase catalyzes the transesterification of an MMBFA with an acceptor alcohol to produce an MMBFA ester.

The MMBFA-derived alcohol producing engineered pathway can comprise the following reactions:

propionate to propionyl-CoA propionyl-CoA to methylmalonyl-CoA methylmalonyl-CoA and fatty acid to MMBFA MMBFA to MMBFA-derived alcohol The instant disclosure also provides a a method of producing an MMBFA and/or an MMBFA-derived product (e.g., a MMBFA ester) comprising (a) providing the engineered microorganism of the present disclosure, and (b) cultivating the engineered microorganism in a culture medium containing a feedstock providing a carbon source for a period of time and under conditions to produce a recoverable amount of MMBFA and/or MMBFA product.

In some aspects, the method further comprises separating the MMBFA and/or MMBFA product from the culture. MMBFAs and/or MMBFA products (e.g., MMBFA acylglycerides, esters, or alcohols) can be extracted from the culture medium or cells and measured using any suitable methods known in the art. Suitable extraction methods include, for example, the methods as described in Bligh et al., Can. J. Biochem. Physiol. 37:911-917 (1959).

Accordingly, also provided in the instant disclosure is a method to recover an MMBFA comprising (i) extracting the MMBFA, wherein the extraction yields a MMBFA-rich phase, (ii) separating the MMBFA-rich phase, and (iii) recovering the MMBFA from the MMBFA-rich phase, wherein the MMBFA is produced by one of the MMBFA-producing engineered microorganism disclosed herein. In some aspects, the method further comprises producing a biofuel, detergent, soap, cosmetic, or emulsifier.

Also provided is a method to recover an MMBFA ester comprising (i) extracting the MMBFA ester, wherein the extraction yields a MMBFA ester-rich phase, (ii) separating the MMBFA ester-rich phase, and (iii) recovering the MMBFA ester from the MMBFA ester-rich phase, wherein the MMBFA ester is produced by one of the MMBFA ester-producing engineered microorganism disclosed herein. In some aspects, the method further comprises producing a biofuel, detergent, soap, cosmetic, or emulsifier.

In some aspects, the MMBFA product comprises an MMBFA. In some aspects, the separation of the MMBFA provides a yield of at least 1, at least 2, at least 3, at least 4, at least 5, at least 6, at least 7, at least 8, at least 9, or at least 10 grams per liter of culture. In some aspects, the separation of the MMBFA provides a yield greater than 10 grams per liter of culture. In some aspects, the MMBFA product comprises an MMBFA ester. In some aspects, the separation of MMBFA ester provides a yield of at least 1, at least 2, at least 3, at least 4, at least 5, at least 6, at least 7, at least 8, at least 9, or at least 10 grams per liter of culture. In some aspects, the separation of the MMBFA ester provides a yield greater than 10 grams per liter of culture. In some aspects, the MMBFA product comprises an MMBFA-containing acylglyceride, e.g., a triacylglyceride. In some aspects, the separation of MMBFA-containing acylglyceride provides a yield of at least 1, at least 2, at least 3, at least 4, at least 5, at least 6, at least 7, at least 8, at least 9, or at least 10 grams per liter of culture. In some aspects, the separation of the MMBFA-containing acylglyceride provides a yield greater than 10 grams per liter of culture. In some aspects, the MMBFA product comprises an MMBFA-derived alcohol. In some aspects, the separation of MMBFA-derived alcohol provides a yield of at least 1, at least 2, at least 3, at least 4, at least 5, at least 6, at least 7, at least 8, at least 9, or at least 10 grams per liter of culture. In some aspects, the separation of the MMBFA-derived alcohol provides a yield greater than 10 grams per liter of culture.

The engineered microorganisms disclosed herein can be used to produce MMBFAs, which in turn are used as precursors to make one or more products, for example, MMBFA esters (i.e., wax esters), MMBFA-containing acyl-glycerides (e.g., monoacylglycerides, diacylglycerides, or triacylglycerides), or MMBFA-derived alcohols (i.e., fatty alcohols). In addition, products biosynthesized (i.e., derived) from MMBFAs include, but are not limited to, phospholipids, alkanes, olefins, and fatty aldehydes. Products biosynthesized according to the methods disclosed herein can be refined or purified according to methods known in the art.

Some host cells naturally generate one or more products derived from MMBFAs, whereas other cells are genetically engineered to convert MMBFAs to, e.g., alkanes, olefins, wax esters, fatty alcohols, phospholipids, acylglycerides (e.g., triglycerides), and/or fatty aldehydes. Organisms and genetic modifications thereof to synthesize products derived from MMBFAs are further described in, e.g., International Patent Publication Nos. WO 2007/136762, WO 2008/151149, and WO 2010/062480, and U.S. Patent Application Publication US 2010/0298612, all of which are hereby incorporated by reference in their entireties.

In one aspect, the methods disclosed herein comprise extracting a product derived from a MMBFA (phospholipid, triglyceride, alkane, olefin, wax ester, fatty alcohol, and/or fatty aldehyde synthesized in the cell from MMBFAs) from the culture. Any extraction method is appropriate, including the extraction methods described in International Patent Publication Nos. WO 2007/136762, WO 2008/151149, and WO 2010/062480, and U.S. Patent Application Publication Nos. US 2010/0251601, US 2010/-242345, US 2010/0105963, and US 2010/0298612.

In some aspects, the MMBFA comprises (i) a fatty acid chain length of about 10 to about 40 carbons; (ii) at least 4 methyl branches located at position 2, 4, 6, and 8 of the fatty acid chain; and, (iii) zero or one unsaturation in the fatty acid chain. In some aspects, at least one methyl branch is located at position 10, 12, or 14 of the fatty acid chain.

In some aspects, the MMBFA ester comprises (i) a fatty acid chain length of about 10 to about 40 carbons; (ii) at least 4 methyl branches located at position 2, 4, 6, and 8 of the fatty acid chain; (iii) zero or one unsaturation in the fatty acid chain; and, (iv) an ester chain length of about 12 to about 64 carbons. In some aspects, at least one methyl branch is located at position 10, 12, or 14 of the fatty acid chain.

The instant disclosure also provided is composition comprising an MMBFA and/or MMBFA product produced by the engineered microorganism disclosed herein (e.g., phospholipid, triglyceride, alkane, olefin, wax ester, fatty alcohol, and/or fatty aldehyde derived from a MMBFA), wherein said composition is a base lubricant, biofuel, detergent, soap, cosmetic, or emulsifier. The present disclosure also provides a composition comprising an MMBFA and/or MMBFA product produced in a cell free system comprising the engineered pathway disclosed herein, wherein said composition is a base lubricant, biofuel, detergent, soap, cosmetic, or emulsifier. The instant disclosure also provides a composition comprising an MMBFA and/or MMBFA product synthesized according to the methods disclosed herein, wherein said composition is a base lubricant, biofuel, detergent, soap, cosmetic, or emulsifier. In some aspects, the compositions comprising an MMBFA and/or MMBFA product synthesized according to the methods disclosed herein further comprise additional components, for example, stabilizers, antioxidants, or excipients.

TABLE 1

Representative list of proteins and protein fragments that can be used according to the pathway engineering methods disclosed herein.

| SEQ ID NO | Description |
|---|---|
| 1 | AT domain from MAS from *Mycobacterium tuberculosis* H37Rv - Fragment comprising amino acids 508 to 890 |
| 2 | KS domain from MAS from *Mycobacterium tuberculosis* H37Rv - Fragment comprising amino acids 7 to 430 |
| 3 | MAS from *Mycobacterium tuberculosis* H37Rv - Refseq NP_217456 |
| 4 | gi\|31794117\|ref\|NP_856610.1\|:1-2111 multifunctional MAS (mycocerosic acid synthase) [*Mycobacterium bovis* AF2122/97] - Homologous to MAS from *Mycobacterium tuberculosis* H37Rv |
| 5 | gi\|289444499\|ref\|ZP_06434243.1\|:1-2111 multifunctional membrane-associated MAS (mycocerosic acid synthase) [*Mycobacterium tuberculosis* T46] - Homologous to MAS from *Mycobacterium tuberculosis* H37Rv |
| 6 | gi\|289575646\|ref\|ZP_06455873.1\|:1-2111 multifunctional mycocerosic acid synthase membrane-associated MAS [*Mycobacterium tuberculosis* K85] - Homologous to MAS from *Mycobacterium tuberculosis* H37Rv |
| 7 | gi\|306804719\|ref\|ZP_07441387.1\|:1-2111 MAS (mycocerosic acid synthase) [*Mycobacterium tuberculosis* SUMu008] - Homologous to MAS from *Mycobacterium tuberculosis* H37Rv |
| 8 | gi\|433636006\|ref\|YP_007269633.1\|:1-2111 Mycocerosic acid synthase [*Mycobacterium canettii* CIPT 140070017] - Homologous to MAS from *Mycobacterium tuberculosis* H37Rv |
| 9 | gi\|433643132\|ref\|YP_007288891.1\|:1-2111 Mycocerosic acid synthase [*Mycobacterium canettii* CIPT 140070008] - Homologous to MAS from *Mycobacterium tuberculosis* H37Rv |
| 10 | gi\|451349478\|ref\|ZP_21914504.1\|1-2099 mycocerosic synthase [*Mycobacterium haemophilum* DSM 44634] - Homologous to MAS from *Mycobacterium tuberculosis* H37Rv |
| 11 | gi\|15826970\|ref\|NP_301233.1\|:1-2109 mycocerosic synthase [*Mycobacterium leprae* TN] - Homologous to MAS from *Mycobacterium tuberculosis* H37Rv |

TABLE 1-continued

Representative list of proteins and protein fragments that can be used according to the pathway engineering methods disclosed herein.

| SEQ ID NO | Description |
| --- | --- |
| 12 | gi|183981780|ref|YP_001850071.1|1-2099 multifunctional mycocerosic acid synthase membrane-associated MAS [*Mycobacterium marinum* M] - Homologous to MAS from *Mycobacterium tuberculosis* H37Rv |
| 13 | gi|118617588|ref|YP_905920.1|1-2099 multifunctional mycocerosic acid synthase membrane-associated MAS [*Mycobacterium ulcerans* Agy99] - Homologous to MAS from *Mycobacterium tuberculosis* H37Rv |
| 14 | gi|443490193|ref|YP_007368340.1|1-2099 multifunctional mycocerosic acid synthase membrane-associated MAS [*Mycobacterium liflandii* 128FXT] - Homologous to MAS from *Mycobacterium tuberculosis* H37Rv |
| 15 | PKS2 from *Mycobacterium tuberculosis* H37Rv - Refseq NP_218342 |
| 16 | gi|289755958|ref|ZP_06515336.1|polyketide synthase PKS2 [*Mycobacterium tuberculosis* EAS054] - Homologous to PKS2 from *Mycobacterium tuberculosis* H37Rv |
| 17 | gi|254233314|ref|ZP_04926640.1|polyketide synthase PKS2 [*Mycobacterium tuberculosis* C] - Homologous to PKS2 from *Mycobacterium tuberculosis* H37Rv |
| 18 | gi|289445426|ref|ZP_06435170.1|polyketide synthase PKS2 [*Mycobacterium tuberculosis* CPHL_A] - Homologous to PKS2 from *Mycobacterium tuberculosis* H37Rv |
| 19 | gi|121639743|ref|YP_979967.1|polyketide synthase [*Mycobacterium bovis* BCG str. Pasteur 1173P2] - Homologous to PKS2 from *Mycobacterium tuberculosis* H37Rv |
| 20 | gi|148825032|ref|YP_001289786.1|polyketide synthase PKS2 [*Mycobacterium tuberculosis* F11] - Homologous to PKS2 from *Mycobacterium tuberculosis* H37Rv |
| 21 | gi|433628968|ref|YP_007262597.1|Putative polyketide synthase PKS2 [*Mycobacterium canettii* CIPT 140060008] - Homologous to PKS2 from *Mycobacterium tuberculosis* H37Rv |
| 22 | gi|433632920|ref|YP_007266548.1|Putative polyketide synthase PKS2 [*Mycobacterium canettii* CIPT 140070010] - Homologous to PKS2 from *Mycobacterium tuberculosis* H37Rv |
| 23 | gi|340628794|ref|YP_004747246.1|putative polyketide synthase PKS2 [*Mycobacterium canettii* CIPT 140010059] - Homologous to PKS2 from *Mycobacterium tuberculosis* H37Rv |
| 24 | gi|294993046|ref|ZP_06798737.1|polyketide synthase PKS2 [*Mycobacterium tuberculosis* 210] - Homologous to PKS2 from *Mycobacterium tuberculosis* H37Rv |
| 25 | gi|424945701|ref|ZP_18361397.1|polyketide synthase [*Mycobacterium tuberculosis* NCGM2209] - Homologous to PKS2 from *Mycobacterium tuberculosis* H37Rv |
| 26 | PKS4 from *Mycobacterium tuberculosis* H37Rv - NCBI Reference Sequence: YP_006514556.1 |
| 27 | gi|31792374|ref|NP_854867.1|polyketide beta-ketoacyl synthase [*Mycobacterium bovis* AF2122/97] - Homologous to PKS4 from *Mycobacterium tuberculosis* H37Rv |
| 28 | gi|433634241|ref|YP_007267868.1|Polyketide beta-ketoacyl synthase PKS3/4 [*Mycobacterium canettii* CIPT 140070017] - Homologous to PKS4 from *Mycobacterium tuberculosis* H37Rv |
| 29 | gi|433641328|ref|YP_007287087.1|Polyketide beta-ketoacyl synthase PKS3/4 [*Mycobacterium canettii* CIPT 140070008] - Homologous to PKS4 from *Mycobacterium tuberculosis* H37Rv |
| 30 | gi|121637112|ref|YP_977335.1|polyketide beta-ketoacyl synthase PKS3 [*Mycobacterium bovis* BCG str. Pasteur 1173P2] - Homologous to PKS4 from *Mycobacterium tuberculosis* H37Rv |
| 31 | gi|289442614|ref|ZP_06432358.1|polyketide beta-ketoacyl synthase [*Mycobacterium tuberculosis* T46] - Homologous to PKS4 from *Mycobacterium tuberculosis* H37Rv |
| 32 | gi|31792374|ref|NP_854867.1|polyketide beta-ketoacyl synthase [*Mycobacterium bovis* AF2122/97] - Homologous to PKS4 from *Mycobacterium tuberculosis* H37Rv |
| 33 | gi|433641328|ref|YP_007287087.1|Polyketide beta-ketoacyl synthase PKS3/4 [*Mycobacterium canettii* CIPT 140070008] - Homologous to PKS4 from *Mycobacterium tuberculosis* H37Rv |
| 34 | gi|121637112|ref|YP_977335.1|polyketide beta-ketoacyl synthase PKS3 [*Mycobacterium bovis* BCG str. Pasteur 1173P2] - Homologous to PKS4 from *Mycobacterium tuberculosis* H37Rv |
| 35 | gi|433626276|ref|YP_007259905.1|Polyketide beta-ketoacyl synthase PKS3/4 [*Mycobacterium canettii* CIPT 140060008] - Homologous to PKS4 from *Mycobacterium tuberculosis* H37Rv |
| 36 | gi|339631248|ref|YP_004722890.1|polyketide beta-ketoacyl synthase [*Mycobacterium africanum* GM041182] - Homologous to PKS4 from *Mycobacterium tuberculosis* H37Rv |

TABLE 1-continued

Representative list of proteins and protein fragments that can be used according to the pathway engineering methods disclosed herein.

| SEQ ID NO | Description |
|---|---|
| 37 | PKS5 from *Mycobacterium tuberculosis* H37Rv - Refseq NP_216043 |
| 38 | gi|424803881|ref|ZP_18229312.1|polyketide synthase PKS5 [*Mycobacterium tuberculosis* W-148] - Homologous to *Mycobacterium tuberculosis* H37Rv PKS5 |
| 39 | gi|440581009|emb|CCG11412.1|polyketide synthase PKS [*Mycobacterium tuberculosis* 7199-99] - Homologous to *Mycobacterium tuberculosis* H37Rv PKS5 |
| 40 | gi|289442981|ref|ZP_06432725.1|polyketide synthase PKS5 [*Mycobacterium tuberculosis* T46] - Homologous to *Mycobacterium tuberculosis* H37Rv PKS5 |
| 41 | gi|254231756|ref|ZP_04925083.1|polyketide synthase PKS5 [*Mycobacterium tuberculosis* C] - Homologous to *Mycobacterium tuberculosis* H37Rv PKS5 |
| 42 | gi|31792713|ref|NP_855206.1|polyketide synthase [*Mycobacterium bovis* AF2122/97] - Homologous to *Mycobacterium tuberculosis* H37Rv PKS5 |
| 43 | gi|289447138|ref|ZP_06436882.1|polyketide synthase PKS5 [*Mycobacterium tuberculosis* CPHL_A] - Homologous to *Mycobacterium tuberculosis* H37Rv PKS5 |
| 44 | gi|340626546|ref|YP_004744998.1|polyketide synthase PKS5 [*Mycobacterium canettii* CIPT 140010059] - Homologous to *Mycobacterium tuberculosis* H37Rv PKS5 |
| 45 | gi|183982353|ref|YP_001850644.1|polyketide synthase PKS5 [*Mycobacterium marinum* M] - Homologous to *Mycobacterium tuberculosis* H37Rv PKS5 |
| 46 | gi|400534236|ref|ZP_10797774.1|mycocerosic acid synthase [*Mycobacterium colombiense* CECT 3035] - Homologous to *Mycobacterium tuberculosis* H37Rv PKS5 |
| 47 | gi|406030447|ref|YP_006729338.1|phthioceranic/hydroxyphthioceranic acid synthase [*Mycobacterium indicus* pranii MTCC 9506] - Homologous to *Mycobacterium tuberculosis* H37Rv PKS5 |
| 48 | PKS7 from *Mycobacterium tuberculosis* H37Rv - Refseq NP_216177 |
| 49 | gi|306788762|ref|ZP_07427084.1|polyketide synthase PKS7 [*Mycobacterium tuberculosis* SUMu004] - Homologous to *Mycobacterium tuberculosis* H37Rv PKS7 |
| 50 | gi|289745901|ref|ZP_06505279.1|polyketide synthase PKS7 [*Mycobacterium tuberculosis* 02_1987] - Homologous to *Mycobacterium tuberculosis* H37Rv PKS7 |
| 51 | gi|254231859|ref|ZP_04925186.1|polyketide synthase PKS7 [*Mycobacterium tuberculosis* C] - Homologous to *Mycobacterium tuberculosis* H37Rv PKS7 |
| 52 | gi|31792848|ref|NP_855341.1|polyketide synthase [*Mycobacterium bovis* AF2122/97] - Homologous to *Mycobacterium tuberculosis* H37Rv PKS7 |
| 53 | gi|340626667|ref|YP_004745119.1|putative polyketide synthase PKS7 [*Mycobacterium canettii* CIPT 140010059] - Homologous to *Mycobacterium tuberculosis* H37Rv PKS7 |
| 54 | gi|433626754|ref|YP_007260383.1|Putative polyketide synthase PKS7 [*Mycobacterium canettii* CIPT 140060008] - Homologous to *Mycobacterium tuberculosis* H37Rv PKS7 |
| 55 | gi|433641800|ref|YP_007287559.1|Putative polyketide synthase PKS7 [*Mycobacterium canettii* CIPT 140070008] - Homologous to *Mycobacterium tuberculosis* H37Rv PKS7 |
| 56 | gi|433630756|ref|YP_007264384.1|Putative polyketide synthase PKS7 [*Mycobacterium canettii* CIPT 140070010] - Homologous to *Mycobacterium tuberculosis* H37Rv PKS7 |
| 57 | gi|183982485|ref|YP_001850776.1|polyketide synthase PKS7 [*Mycobacterium marinum* M] - Homologous to *Mycobacterium tuberculosis* H37Rv PKS7 |
| 58 | gi|41407468|ref|NP_960304.1|PKS7 [*Mycobacterium avium* subsp. *paratuberculosis* K-10] - Homologous to *Mycobacterium tuberculosis* H37Rv PKS7 |
| 59 | PKS8 + PKS17 from *Mycobacterium tuberculosis* H37Rv (Refseq NP_216178.1 and Refseq NP_216179.1, respectively) |
| 60 | gi|340626668|ref|YP_004745120.1|polyketide synthase PKS8 [*Mycobacterium canettii* CIPT 140010059] - Homologous to PKS8 + PKS17 from *Mycobacterium tuberculosis* H37Rv |
| 61 | PKS12 from *Mycobacterium tuberculosis* H37Rv - Refseq NP_216564.2 |
| 62 | gi|254232218|ref|ZP_04925545.1|hypothetical protein TBCG_02001 [*Mycobacterium tuberculosis* C] - Homologous to *Mycobacterium tuberculosis* H37Rv PKS12 |
| 63 | gi|289447668|ref|ZP_06437412.1|polyketide synthase PKS12 [*Mycobacterium tuberculosis* CPHL_A] - Homologous to *Mycobacterium tuberculosis* H37Rv PKS12 |
| 64 | gi|294996987|ref|ZP_06802678.1|polyketide synthase PKS12 [*Mycobacterium tuberculosis* 210] - Homologous to *Mycobacterium tuberculosis* H37Rv PKS12 |

TABLE 1-continued

Representative list of proteins and protein fragments that can be used according to the pathway engineering methods disclosed herein.

| SEQ ID NO | Description |
|---|---|
| 65 | gi|298525551|ref|ZP_07012960.1|polyketide synthase [*Mycobacterium tuberculosis* 94_M4241A] - Homologous to *Mycobacterium tuberculosis* H37Rv PKS12 |
| 66 | gi|121637934|ref|YP_978157.1|polyketide synthase [*Mycobacterium bovis* BCG str. Pasteur 1173P2] - Homologous to *Mycobacterium tuberculosis* H37Rv PKS12 |
| 67 | gi|340627059|ref|YP_004745511.1|putative polyketide synthase PKS12 [*Mycobacterium canettii* CIPT 140010059 - Homologous to *Mycobacterium tuberculosis* H37Rv PKS12 |
| 68 | gi|183983026|ref|YP_001851317.1|polyketide synthase [*Mycobacterium marinum* M] - Homologous to *Mycobacterium tuberculosis* H37Rv PKS12 |
| 69 | gi|443490925|ref|YP_007369072.1|polyketide synthase, PKS12 [*Mycobacterium liflandii* 128FXT] - Homologous to *Mycobacterium tuberculosis* H37Rv PKS12 |
| 70 | gi|118617785|ref|YP_906117.1|polyketide synthase [*Mycobacterium ulcerans* Agy99] - Homologous to *Mycobacterium tuberculosis* H37Rv PKS12 |
| 71 | gi|433631164|ref|YP_007264792.1|Polyketide synthase PKS12 required for biosynthesis of mannosyl-beta-1-phosphomycoketide (MPM) [*Mycobacterium canettii* CIPT 140070010] - Homologous to *Mycobacterium tuberculosis* H37Rv PKS12 |
| 72 | FADD28 from *Mycobacterium tuberculosis* H37Rv - Refseq NP_217457 |
| 73 | FADD21 from *Mycobacterium tuberculosis* H37Rv - Refseq NP_215701 |
| 74 | FADD23 from *Mycobacterium tuberculosis* H37Rv - Refseq NP_218343 |
| 75 | FADD24 from *Mycobacterium tuberculosis* H37Rv - Refseq NP_216045 |
| 76 | PAPA5 from *Mycobacterium tuberculosis* H37Rv - Refseq: NP_217455 |
| 77 | PAPA3 from *Mycobacterium tuberculosis* H37Rv - Refseq NP_215698 |
| 78 | PAPA1 from *Mycobacterium tuberculosis* H37Rv - Refseq NP_218341 |
| 79 | PAPA4 from *Mycobacterium tuberculosis* H37Rv - Refseq NP_216044 |
| 80 | PRPE from *Escherichia coli* BL21 - Refseq YP_003052959 |
| 81 | PCC complex from *S. coelicolor* A3, ACCA1 from *Streptomyces coelicolor* - Refseq NP_733754 |
| 82 | PCC complex from *S. coelicolor* A3, ACCA2 from *Streptomyces coelicolor* - Refseq NP_629074.1 |
| 83 | PCC complex from *S. coelicolor* A3, PCCB from *Streptomyces coelicolor* - Refseq NP_629079.1 |
| 84 | PCC complex from *S. coelicolor* A3, PCCE from *Streptomyces coelicolor* - Refseq NP_629078.1 |
| 85 | MATB (malonyl/methylmalonyl-CoA ligase) from *Streptomyces coelicolor* (gi 7414558) |
| 86 | Methyl-malonyl-CoA mutase/epimerase from *Propionibacterium freudenreichii* subsp. *shermanii* CIRM-BIA1 - methylmalonyl-CoA mutase subunit alpha - Refseq YP_003687736 |
| 87 | Methyl-malonyl-CoA mutase/epimerase from *Propionibacterium freudenreichii* subsp. *shermanii* CIRM-BIA1 - methylmalonyl-CoA mutase subunit beta - Refseq YP_003687737 |
| 88 | Methyl-malonyl-CoA mutase/epimerase from *Propionibacterium freudenreichii* subsp. *shermanii* CIRM-BIA1 - methylmalonyl-CoA epimerase - Refseq YP_003688018 |
| 89 | TESA' from *Escherichia coli* K-12 - fragment of Refseq NP_415027 |
| 90 | Phosphopantetheinyl transferase [*Bacillus subtilis* subsp. *subtilis* str. JH642] Refseq ZP_03598723.1 |

EQUIVALENTS

Those skilled in the art will recognize, or be able to ascertain using no more than routine experimentation, many equivalents to the specific embodiments of the invention described herein. Such equivalents are intended to be encompassed by the following claims.

All publications, patents, and patent applications referred to herein are expressly incorporated by reference in their entireties.

EXAMPLES

Materials and Methods

1. Strains, Plasmids, and Primers

Strains, plasmids and oligonucleotides used in the Examples presented below are detailed in TABLES 2, 3 and 4, respectively.

TABLE 2

Source Strains

| Name | Description | Reference/Source |
|---|---|---|
| DH5α | *E. coli* K12 F⁻ lacU169 (Φ80lacZΔM15) endA1 recA1 hsdR17 deoR supE44 thi-1 l2 gyrA96 relA1 | Hanahan, *J. Mol. Biol.* 1983, 166: 557-580. |
| BAP1 | F-ompT hsdSB (rB-mB-) gal dcm (DE3) DprpRBCD::T7prom-sfp,T7prom-prpE | Pfeifer et al., Science 2001, 291: 1790-1792. |
| K207-3 | BAP1, panD::panDS25A ygfG::T7prom-accA1-T7prom-pccB-T7term | Murli et al., *J. Ind. Microbiol Biotechnol* 2003, 30: 500-509. |
| MB01 | BAP1, ygfG::T7prom-accA1-T7prom-pccB-T7-pccE-T7term | Newly designed, present disclosure |

TABLE 3

| | Plasmids | |
|---|---|---|
| Name | Description | Reference/Source |
| pET21 | Vector for protein expression under the strong T7 promoter; $Ap^R$ | Obtained from Novagen |
| pET28 | Vector for expression of N terminal His-tagged proteins under the strong T7 promoter; $Kn^R$ | Obtained from Novagen |
| pBAD33 | Vector for recombinant protein expression under the control of the $P_{BAD}$ promoter; $Cm^R$ | Guzman et al., *J. Bacteriol.* 1995, 177: 4121-4130 |
| pRT23 | pET21 derivative vector containing mas gene; $Ap^R$ | Trivedi et al., *Mol Cell* 2005, 17: 631-643. |
| pKO3 | Vector for gene replacement, $Cm^R$ | Link et al., *J. Bacteriol.* 1997, 179: 6228-6237. |
| pMB00 | pKO3 derivative vector containing ygfG homology arms and T7 promoter-accA1-pccB-pccE expression cassette | Newly designed, present disclosure |
| pMB01 | pET28 derivative vector containing papA5 gene; $Kn^R$ | Newly designed, present disclosure |
| pMB02 | pET28 derivative vector containing fadD28 gene; $Kn^R$ | Newly designed, present disclosure |
| pMB03 | pET28 derivative vector containing tesA' gene; $Kn^R$ | Newly designed, present disclosure |
| pMB04 | pET28 derivative vector containing papA5 and fadD28 genes; $Kn^R$ | Newly designed, present disclosure |
| pMB05 | pET28 derivative vector containing tesA and fadD28 genes; $Kn^R$ | Newly designed, present disclosure |
| pMB06 | pBAD33 derivative vector containing papA5 gene; $Cm^R$ | Newly designed, present disclosure |
| pMB07 | pBAD33 derivative vector containing fadD28 gene; $Cm^R$ | Newly designed, present disclosure |
| pMB08 | pBAD33 derivative vector containing tesA' gene; $Cm^R$ | Newly designed, present disclosure |
| pMB09 | pBAD33 derivative vector containing papA5 and fadD28 genes; $Cm^R$ | Newly designed, present disclosure |
| pMB10 | pBAD33 derivative vector containing tesA' and fadD28 genes; $Cm^R$ | Newly designed, present disclosure |
| pMB11 | pET28 derivative vector containing papA5, fadD28 and mas; $Km^R$ | Newly designed, present disclosure |
| pMB12 | pET28a derivative vector containing ahr gene; $Km^R$ | Newly designed, present disclosure |
| pMB13 | pET28a derivative vector containing acr1 gene; $Km^R$ | Newly designed, present disclosure |
| pMB14 | pET22b derivative vector containing ahr gene; $Ap^R$ | Newly designed, present disclosure |
| pMB15 | pET22b derivative vector containing acr1 gene; $Ap^R$ | Newly designed, present disclosure |
| pMB16 | pET22b derivative vector containing car gene; $Ap^R$ | Newly designed, present disclosure |
| pMB17 | pET22b derivative vector containing far gene; $Ap^R$ | Newly designed, present disclosure |
| pMB18 | pET22b derivative vector containing ahr and acr1 genes; $Ap^R$ | Newly designed, present disclosure |
| pMB19 | pET22b derivative vector containing ahr and car genes; $Ap^R$ | Newly designed, present disclosure |
| pMB20 | pBAD33 derivative vector containing accA, accB, accC and accD genes under the T7 promoter; $Cm^R$ | Newly designed, present disclosure |
| pMB21 | pET22b derivative vector containing pdc and adhB genes; $Ap^R$ | Newly designed, present disclosure |
| pMB22 | pRT802 derivative vector containing mas, faal28 and papA5 genes under the ermE* promoter; $Km^R$ | Newly designed, present disclosure |
| pMB23 | pRT802 derivative vector containing mas, faal28 and papA5 genes under the tcp830 promoter; $Km^R$ | Newly designed, present disclosure |
| pMB24 | pMP349 derivative vector containing mas, faal28 and papA5 genes under the PgroEL*promoter; $Am^R$ | Newly designed, present disclosure |
| pMB25 | pMP395 derivative vector containing mas, faal28 and papA5 genes under the ace promoter; $Am^R$ | Newly designed, present disclosure |
| pAH162 | Plasmid containing φ80 phage attP sequence; TcR | Haldimann et al., *J. Bacteriol.* 183, 6384-93 (2001). |

TABLE 4

Oligonucleotide primers(*)

| Name | Sequence |
|---|---|
| papA5_F | CATATGTTTCCCGGATCTGTGATCC (SEQ ID NO: 91) |
| papA5_R | CTGCAGACTAGTAGATCGGCGGGCTGGTTGCTTAG (SEQ ID NO: 92) |
| fadD28_F | CATATGAGTGTGCGTTCCCTTCCCG (SEQ ID NO: 93) |
| fadD28_R | CTGCAGACTAGTAATTCTGTGTAGACGGCCAGCC (SEQ ID NO: 94) |
| tesA_F | CATATGCTGGCCCGTCACGGACCAC (SEQ ID NO: 95) |
| tesA_R | CTGCAGACTAGTGGCCAGCTACATCCGGAGCATAG (SEQ ID NO: 96) |

(*)Restriction sites are shown underlined

2. Plasmid Construction

The pRT23 vector, a pET21 derivative vector containing the mas gene (Rv2940c) (SEQ ID NO:97) (see Trivedi et al., *Mol Cell* 2005, 17: 631-643) was used to engineer the microorganism strains disclosed herein. The papA5 (Rv2939) gene (SEQ ID NO:98), the fadD28 (Rv2941) gene (SEQ ID NO:99 were amplified by PCR from *M. tuberculosis* H37Rv genomic DNA using the primer pairs papA5_F/papA5_R (SEQ ID NOs: 91 and 92) and fadD28_F/fadD28_R (SEQ ID NOs:93 and 94), respectively. The resulting PCR products were cloned in the pCR®-BluntII-TOPO vector and verified by DNA sequencing. The tesA' gene from *E. coli* was amplified by PCR using the primer pairs tesA_F/tesA_R (SEQ ID NOs:95 and 96).

The DNA fragments containing the papA5, fadD28 and tesA genes were cloned as NdeI/EcoRI digests in the pET28a(+) vector, yielding the pMB01, pMB02 and pMB03 plasmids, respectively. The fragment containing the RBS sequence and the fadD28 gene was obtained from pMB02 by restriction with XbaI/HindIII enzymes, and it was further cloned in SpeI/HindIII sites of the pMB01 and pMB03 plasmids, yielding the pMB04 and pMB05 plasmids. These plasmids contained papA5 and tesA' genes constituting a bicistronic operon together with fadD28, respectively.

Finally, plasmids pMB01, pMB02, pMB03, pMB04, and pMB05 were digested with XbaI/HindIII restriction enzymes, and the resulting fragments were subsequently cloned in the XbaI/HindIII sites of the pBAD33 vector, thus yielding the pMB06, pMB07, pMB08, pMB09, and pMB10 plasmids respectively.

3. Expression of MAS, PAPA5, and FADD28 Proteins in Engineered Bacterial Strains

*E. coli* transformants containing either the pRT23 plasmid, or the pRT23 plasmid plus the pMB09 plasmid were grown in Luria-Bertani medium (LB medium) at 37° C. At mid exponential-phase, cell cultures were induced with 0.5 mM isopropyl-D-thiogalactopyranoside (IPTG) and 0.2% L-arabinose, and incubated for 20 hours at 22° C. Cells were harvested by centrifugation at 5,000×g for 10 minutes at 4° C., washed twice, and resuspended with 50 mM Tris-HCl buffer (pH 8.0).

Cell disruption was carried out in a BIORUPTOR® sonication system (Diagenode) in the presence of 1% (volume/volume) protease inhibitor cocktail (Sigma-Aldrich). The lysate was cleared by centrifugation at 20,000×g for 30 minutes at 4° C. The supernatant was analyzed by sodium dodecyl sulfate-polyacrylamide gel electrophoresis (SDS-PAGE) in 8% acrylamide gels. After soluble total protein sample separation on 8% SDS-PAGE gels, proteins were transferred to a nitrocellulose membrane for western blotting. Proteins were recognized using anti-His antibodies, and were visualized using enhanced chemiluminescence (ECL Plus) reagents (Amersham GE).

4. Bioconversion Assays—Neutral Lipid Analysis

To evaluate the heterologous biosynthesis of MMBFA esters (wax esters) in engineered bacterial strains, *E. coli* MB01 strain cells carrying plasmids pRT23 and pMB09 were grown in LB medium supplemented with 15 µM biotin at 37° C. At mid-exponential phase culture, cell cultures were induced with 0.5 mM IPTG and 0.2% L-arabinose, labelled with 2 µCi [$^{14}$C]-propionate (56 mCi/mmol, PerkinElmer), and supplemented with 1 mM propionate, 3.5 mM oleate, 1% Brij-58, and 1 mM octanol.

Once induced and supplemented, the cell culture was incubated for 20 hours at 22° C. Cells were harvested and total lipids were extracted from the supernatant and cell material using the Blight and Dyer method (Blight and Dyer, Can. J. Biochem. Physiol. 37:911-917, 1959). Total lipid extracts were evaporated and the radioactivity incorporated into each lipid fraction was quantified using a scintillation counter (Rackbetta VER).

Total lipid extracts were analysed by thin layer chromatography (TLC) on silica gel 60 F254 plates (0±2 mm, Merck) (Waltermann & Steinbuchel, FEMS Microbiol. Lett. 2000, 190:45-50) using the hexane/diethylether/acetic acid (70:30:1, v/v/v) solvent system. Lipid fractions were visualized using a Storm 860 PHOSPHORIMAGER® (Molecular Dynamics), and spots corresponding to MMBFA esters were identified by comparison with the migration of known standards.

5. Identification of Synthesized Products by LC-MS

To determine the identity of the MMBFA esters synthesized by the engineered bacterial strains, total lipids were extracted from the *E. coli* MB01 strain carrying the pRT23 and pMB09 plasmids using the Bligh & Dyer method. Lipids were separated by TLC using hexane/diethylether/acetic acid (90:7.5:1 v/v) as the mobile phase. The MMBFA ester products were identified by comparison with known standards, scrapped from the silica plate, and subsequently extracted twice with chloroform. The organic solvent was dried, the lipid pellet was solubilised in 50 µL of methanol:chloroform (4:1 v/v), and 5 µL aliquots of solubilized lipid were subjected to HPLC and LC-MS analysis.

The organic extracts were separated on a ZORBAX® Eclipse XDB-C8 column (3.0×50 mm, particle size=1.8 µm; Agilent, USA) using a binary solvent system consisting of water (Solvent A) and methanol (Solvent B). Both Solvent A and Solvent B were supplemented with 5 mM ammonium acetate. The gradient sequence used in the HPLC separation was: t=0-80% B; t=10 minutes-100% B; t=16 minutes-100% B; t=20 minutes-80% B. The outlet of the liquid chromatograph was connected to a micrOTOF mass spectrometer (Bruker Daltonik, Bremen, Germany) operating in the positive-ion mode. The data was acquired online in the mass range m/z 35-1000.

6. Incorporation of Different Primary Alcohols

To test the ability of the engineered microorganism strains to incorporate different chain length primary alcohols as feedstock for the synthesis of MMBFA esters, a culture of *E. coli* strain MB01 carrying the pRT23 and pMB09 plasmids was grown, induced, and labelled as described above. Cell cultures were supplemented with 1 mM propionate, 3.5 mM oleate, and 1% (w/v) Brij-58. Aliquots of culture were taken and supplemented with 1 mM of ethanol, propanol, butanol, pentanol or octanol. Stock solutions of the different alcohols were prepared at a final concentration of 500 mM in ethanol. Finally, cultures were processed as described in the previous sections and lipid fractions were resolved by TLC and visualized using a Storm 860 PhosphorImager (Molecular Dynamics).

7. Evaluation of the Effect of Different Substrate Concentrations on MMBFA Ester Production In order to optimize the production of MMBFA esters, different concentrations of propionate and octanol feedstocks were tested. To determine the optimum concentration of propionate, a culture of *E. coli* strain MB01 carrying plasmids pRT23 and pMB09 was grown and induced as described above. The culture was supplemented with 2.5 mM octanol, 2.5 mM oleate, and 0.7% (w/v) Brij-58. Aliquots of culture were taken and supplemented with 0.1, 0.5, 1, 2, 4, 6, 8, or 10 mM propionate. Cultures were incubated for 20 hours at 22° C., cells were harvested, and total lipids were extracted from cell material using the Blight and Dyer method. The extracts were resolved by TLC and visualized using $Cu_3PO_4$ staining.

To determine the optimum concentration of octanol, a culture of *E. coli* strain MB01 carrying plasmids pRT23 and pMB09 was grown and induced as detailed previously. The culture was supplemented with 10 mM propionate, 2.5 mM oleate and 0.7% (w/v) Brij-58. Aliquots of culture were taken and supplemented with 0.1, 0.5, 1, 1.5, 2 or 2.5 mM octanol. Cultures were incubated for 20 hours at 22° C. Cells were processed and total lipids were extracted and visualized as described above for the propionate concentration test.

From these tests we have determined 10 mM propionate and 2.5 mM octanol as the optimal substrate concentrations for the bioconversion assay.

Example 1

Heterologous MMBFA Ester Biosynthesis in Metabolically Engineered *E. coli*

1. Selection of the Heterologous Host

Owing to the wealth of genetic and metabolic knowledge associated with *Escherichia coli*, this bacterium is the most convenient starting point for engineering microbial catalysts for lubricants or biofuel production. For instance, *E. coli* is used today to produce diverse high-volume chemicals including polyhydroxybutyrate (a biodegradable plastic) (Steinbuchel, Curr. Opin. Biotechnol. 2005, 16:607-613.), 1,3-propanediol (carpet fiber monomer) (Nakamura et al., Curr. Opin. Biotechnol. 2003, 14:454-459), and amino acids (animal feed additives) (Park et al., Curr. Opin. Biotechnol. 2008, 19:454-460). Remarkably, *E. coli* has also been used as a heterologous host for the production of polyketide derivative compounds being synthesized by using malonyl-CoA and methylmalonyl-CoA as elongating units (examples are the erythromycin precursor polyketide 6-deoxyerythronolide B (6dEB) (Pfeifer et al., Science 2001, 291:1790-1792.), yersiniabactin (Pfeifer et al., Appl. Environ. Microbiol. 2003, 69:6698-6702), a polyketide-nonribosomal peptide hybrid, and an ansamycin polyketide precursor (Watanabe et al., Proc. Natl. Acad. Sci. USA 2003, 100: 9774-9778.).

2. Host Design: Engineering of Methyl-Branched Wax Biosynthesis

The metabolic pathway designed for the biosynthesis of MMBFA in an *E. coli* recombinant strain consists in the assembly of part of the PDIM biosynthesis genes native to *M. tuberculosis* (Trivedi et al., Mol. Cell 2005, 17:631-643) and the propionyl-CoA carboxylase encoding genes from *S. coelicolor* (see FIG. 3). Thus, production of methyl-branched fatty acids and their esters in *E. coli* will requires the heterologous expression of an iterative polyketide synthase (MAS from *M. tuberculosis*), the relaxed phosphopantetheinyl transferase Sfp from *B. subtilis* (Lambalot et al., Chem. Biol. 1996, 3:923-936), the FAAL28 enzyme from *M. tuberculosis*, and the ester synthase PAPA5 from *M. tuberculosis*.

Since *E. coli* does not normally accumulates methylmalonyl-CoA, the host also needs the expression of a heterologous propionyl-CoA carboxylase (PCC) from *Streptomyces* (Diacovich et al., J. Biol. Chem. 2002, 277:31228-31236) or *Mycobacterium* (Gago et al., J. Bacteriol. 2006, 188:477-486), or any other heterologous pathway capable of generating this precursor like: the *S. coelicolor* malonyl/methylmalonyl-CoA ligase (matB) or the *Propionibacteria shermanii* methylmalonyl-CoA mutase/epimerase (Murli et al., J. Ind. Microbiol. Biotechnol. 2003, 30:500-509).

Figure 3:
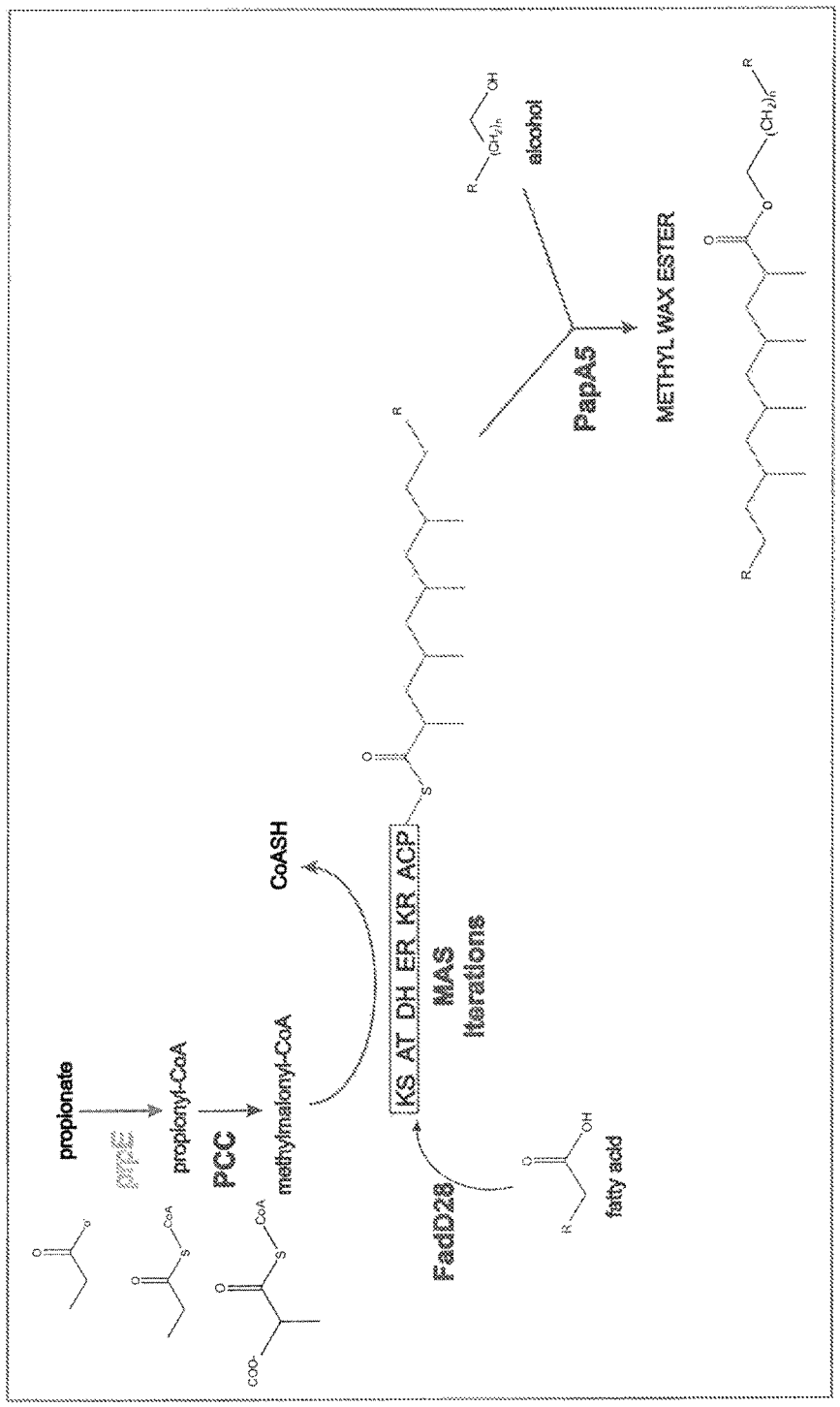

An *E. coli* strain containing all the heterologous genes encoding for the proteins described above was cloned under the transcriptional regulation of the T7 or BAD promoters (Studier et al., Methods Enzymol. 1990, 185:60-89; Guzman et al., J. Bacteriol. 1995, 177:4121-4130.). By the regulated expression of all these components in the *E. coli* strain MB01 (see below), we were able to produce different MMBFE esters that were synthesized by the esterification of long-chain MMBFAs with different alcohols that were supplemented to the medium. A schematic representation of the resulting engineered pathway is shown in FIG. 3.

3. Strain Construction

The construction of producer *E. coli* strain MB01 was accomplished by using the *E. coli* strain K207-3 (Murli et al., J. Ind. Microbiol. Biotechnol. 2003, 30:500-509) as starting point. The K207-3 strain contains a *B. subtilis* sfp gene which enables posttranslational modification of heterologous ACP proteins (or ACP domains) expressed in *E. coli*. Therefore, a single copy of the sfp gene under control of the T7 RNA polymerase promoter was integrated in the prpRBCD operon of BL21(DE3) (Pfeifer et al., Science 2001, 291:1790-1792.). This genetic locus was chosen because the prp operon is responsible for propionate catabolism in *E. coli* (Horswill et al., J. Bacteriol. 1999, 181:5615-5623.), so the ability of this strain to utilize propionate as a carbon and energy source was eliminated.

At the same time, the prpE gene was placed under control of an IPTG-inducible T7 promoter. PrpE can convert propionate into propionyl-CoA, the substrate of the PCC complex (Horswill et al., Microbiology 1999, 145:1381-1388); therefore, in the presence of exogenous propionate, propionyl-CoA was expected to accumulate inside the cell. Because methylmalonyl-CoA has not been observed as a metabolite in *E. coli*, the production of compounds synthesized from this precursor required the re-engineering of its metabolism. Therefore, the next engineering step in K207-3 included the introduction of a suitable pathway for (2S)-methylmalonyl-CoA biosynthesis. For this biosynthetic step, two of the three components of the PCC complex from *S. coelicolor* (pccA-pccB) were cloned under the control of the T7 promoter and integrated in the *E. coli* ygfG gene. The ygfG gene codes for a putative methylmalonyl-CoA decarboxylase; hence, integration into the ygfG locus inactivated the ygfG methylmalonyl-CoA decarboxylase gene. As a result, methylmalonyl-CoA decarboxylase activity was abolished.

Based on this strain, a new E. coli derivative was constructed where the three genes of S. coelicolor PCC complex (accA1-pccB-pccE) (Diacovich et al., J. Biol. Chem. 2002, 277:31228-31236) were cloned in an operon fashion under the control of the T7 promoter and integrated in the ygfG locus. The pccE gene encodes the ε-subunit of PCC and serve as the adaptor protein between α and β subunits (AccA1 and PccB, respectively) resulting in a complex with enhanced enzyme activity. This resulting strain was named MB01. Then, the mas (Rv2940c), papA5 and fadD28 genes from M. tuberculosis were cloned in different expression vectors such as the pET serie (Novagen) and pBAD33 (see TABLE 3).

Plasmids pRT23 and pMB09 were introduced via transformation into E. coli MB01 strain. Alternatively, plasmids pRT23 and pMB04 were introduced via transformation into E. coli MB01 strain. In both E. coli recombinant derivatives (MB01/pRT23/pBM09 and MB01/pRT23/pBM04) the mas gene was under the control of the T7 promoter, while the genes papA5 and faal28 were controlled by the BAD or the T7 promoter, respectively. These strains were constructed to examine and compare the MMBFA ester production and yields (see below).

As mentioned above, the PAPA5 protein can directly transfer the MBFA from the MAS protein to alcohols (Onwueme et al., Proc. Natl. Acad. Sci. USA 2004, 101: 4608-4613), and FADD28 is a member of a family of fatty acyl AMP ligases (FAALs) that activate fatty acids as acyl adenylates and is believed to be involved in activating the MAS starting substrates (medium- to long-chain fatty acids) (FIG. 3).

4. Bioconversion Experiments

In M. tuberculosis MAS carries out the biosynthesis of the multi methyl-branched fatty acid named mycoserosic acid by the iterative elongation of C18-20 fatty acids starters with methylmalonyl CoA extender units (Azad et al., Proc. Natl. Acad. Sci. USA 1996, 93:4787-4792; Mathur et al., J. Biol. Chem. 1992, 267:19388-19395; Onwueme et al., Proc. Natl. Acad. Sci. USA 2004, 101:4608-4613). Therefore, based on the activities of the MAS, PAPA5 and FADD28 we selected the three genes encoding for these three enzymes to be heterologously expressed in E. coli in order to convert a fatty acid and an alcohol into a MMBFA ester (FIG. 3).

Initially, soluble cell fractions of IPTG (or IPTG plus arabinose) induced strains MB01/pRT23/pBM09 and MB01/pRT23/pBM04 were analyzed by Western blotting with an anti-His monoclonal antibody. The experiment revealed that co-expression of the mas, papA5 and fadD28 genes (His-tagged versions) was successfully achieved and proteins were produced soluble in detectable quantities (data not shown). Furthermore, SDS-PAGE of soluble cell extracts revealed that the genes mas and fadD28 produced sufficient protein as to be detected by Coomassie Blue staining of gels (data not shown).

To analyze the ability of MB01/pRT23/pMB09 or MB01/pRT23/pBM04 strain to produce MBW esters, we performed the bioconversion assay described above in Material and Methods (Neutral lipid production). Since both strains were comparable in terms of production and yields of MMBFA ester, only the results obtained for MB01/pRT23/pMB09 are described.

The induction of MB01/pRT23/pMB09 with arabinose, IPTG followed of an incubation at 22° C. for 20 h in the presence of 0.1% (v/v) oleate, 1 mM n-octanol, 1 mM propionate resulted in the de novo synthesis of substantial amounts of wax esters by the recombinant E. coli strain as shown by TLC analysis (FIG. 4, lane 2). Heterologous expression of MAS, MAS plus FADD28 or MAS plus PAPA5 did not result in the biosynthesis of detectable amounts of wax esters by the corresponding recombinant E. coli during cultivation on LB medium under the same condition described above (0.1% (v/v) oleate, 1 mM n-octanol, 1 mM propionate) as revealed by TLC analysis (FIG. 4, lane 1, lane 3 and lane 4; respectively). Bioconversion assays carried out with the BAP1/pRT23/pMB09 strain showed negligible MMBFA ester production. The BAP1 E. coli strain (Pfeifer et al., Science 2001, 291:1790-1792) was similar to the MB01 strain except that it does not contain the PCC encoding genes. Thus, these results indicated that the co-expression of the S. coelicolor PCC complex in MB01 was crucial for the supply of the extender unit (2S)-methylmalonyl-CoA and as a consequence for MMBFA ester formation.

Additionally, MMBFA ester synthesis could be achieved by the E. coli strain MB01/pRT23/pMB09 without the addition of exogenous oleate (FIG. 5, lane 1), indicating that endogenous fatty acids could be used as starter units by MAS. However, the presence of this fatty acid (C18:1) in the cultivation medium lead to an approximately five-fold increase in wax ester formation (FIG. 5, lane 2).

Figure 6:
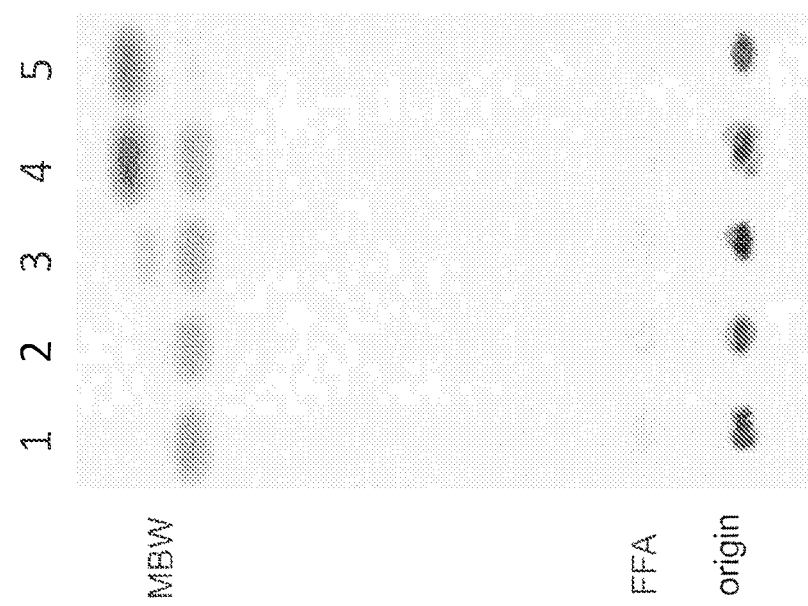

Also, we observed that a successful bioconversion assay could be achieved using different alcohol acceptor molecules. For example, the addition of ethanol, butanol, or pentanol directed the formation of the corresponding methyl-branched ester (FIG. 6).

Figure 7:
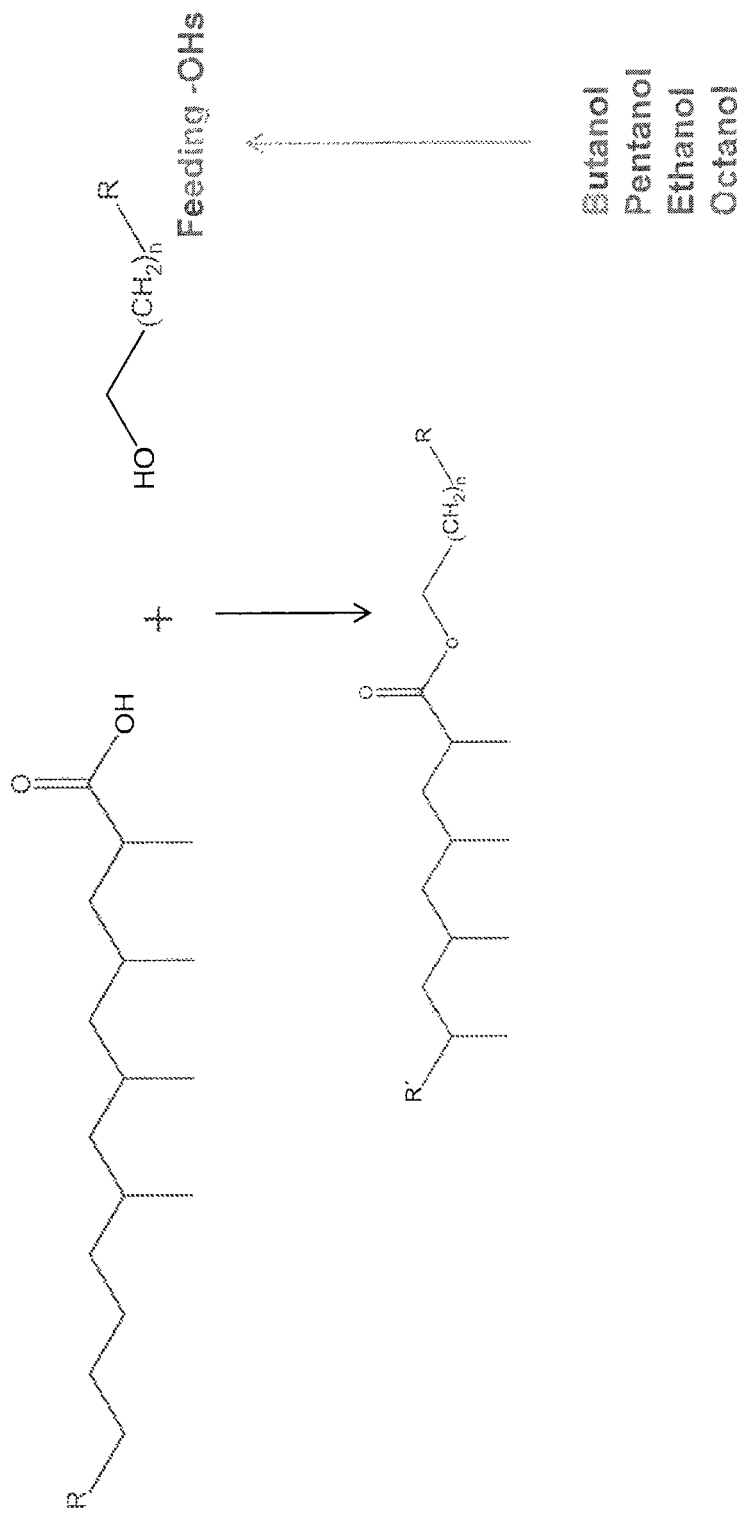
FIG. 7 is a diagram showing the synthesis of MMBFA esters from alcohol feedstocks. Examples of feedstock alcohols that can be used to produce MMBFA esters are shown.
Figure 8A:
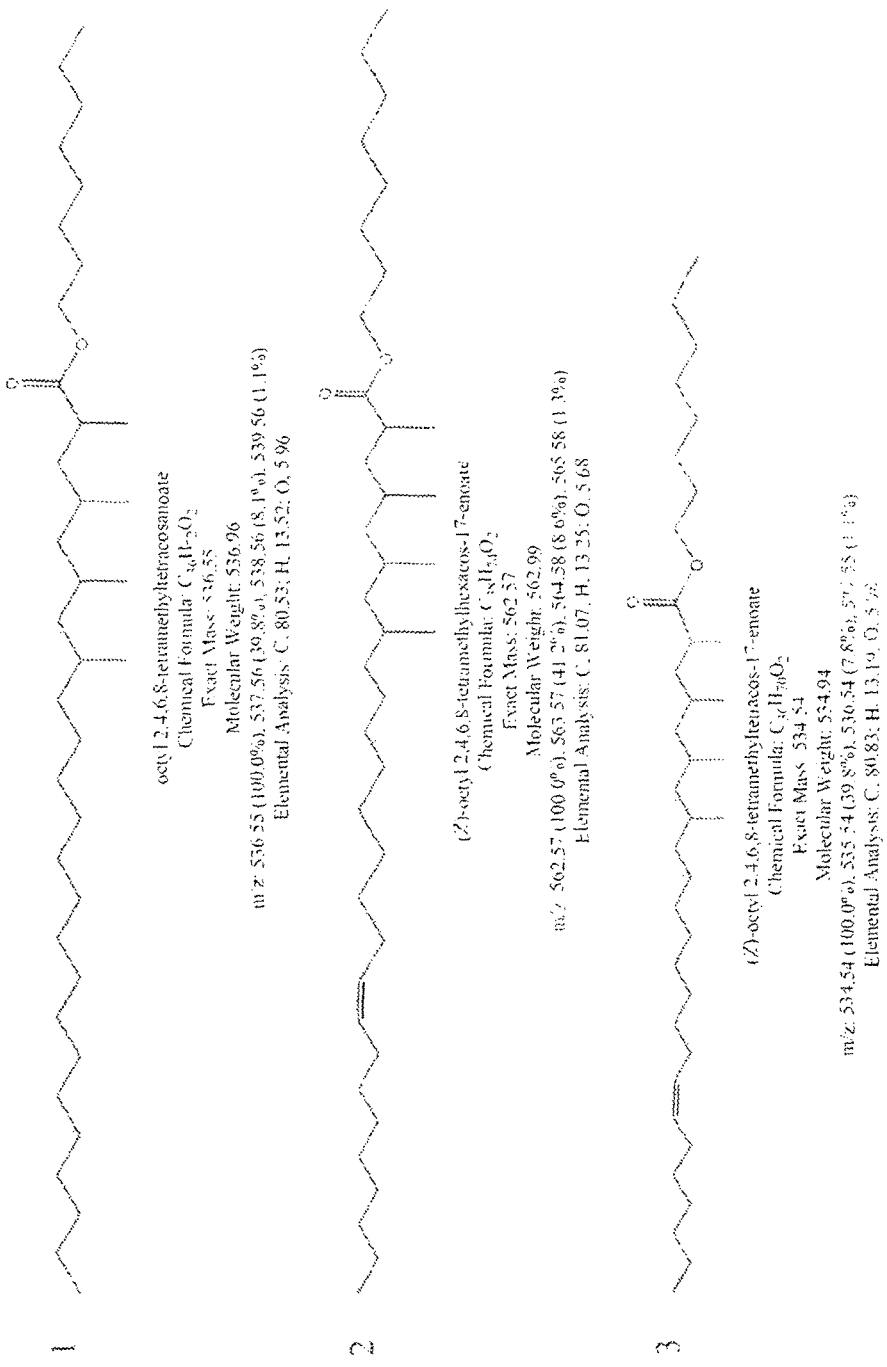
FIGS. 8A, 8B and 8C show the formulas of the major products observed among the MMBFA esters produced by engineered bacteria generated as disclosed in the instant application.
Figure 8B:
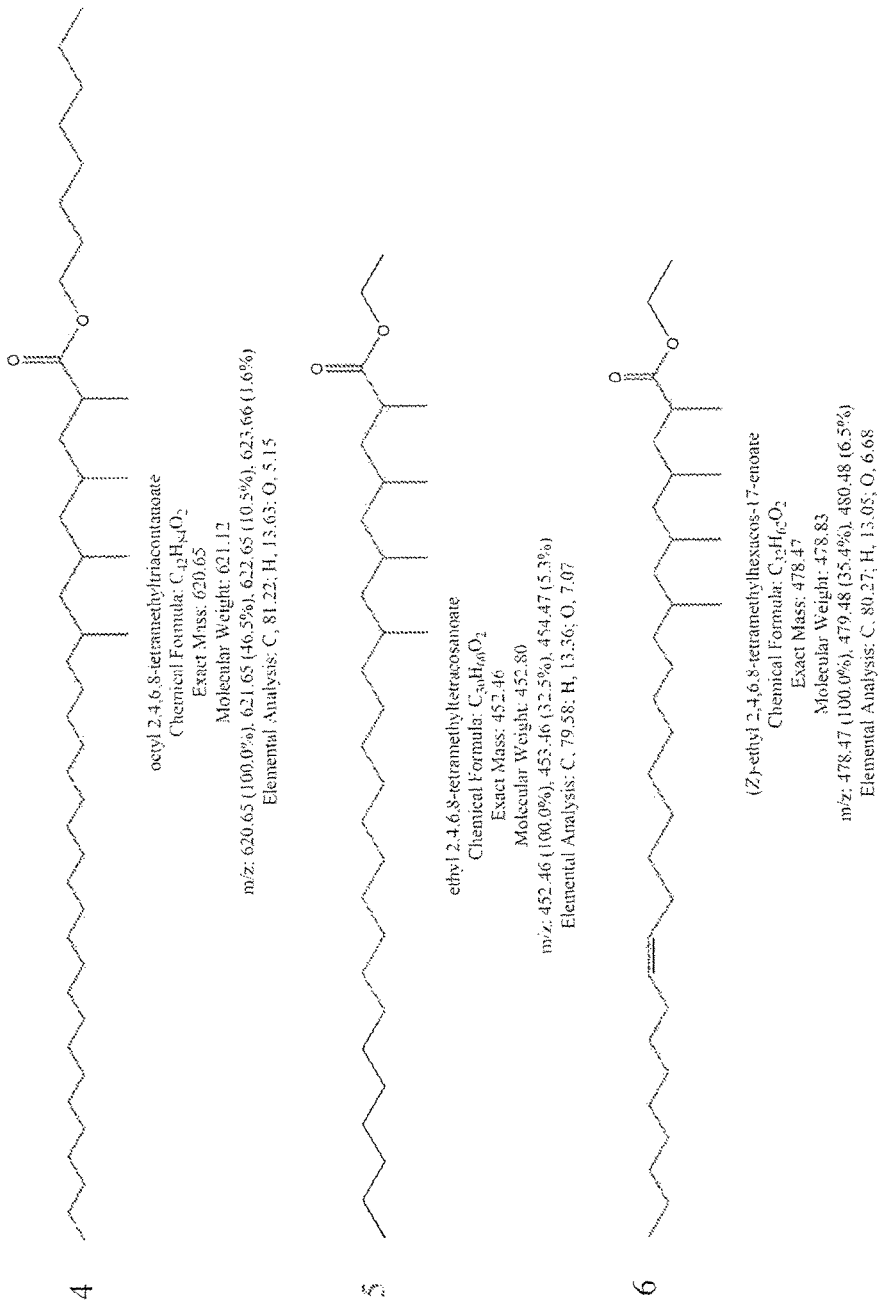
Figure 8C:
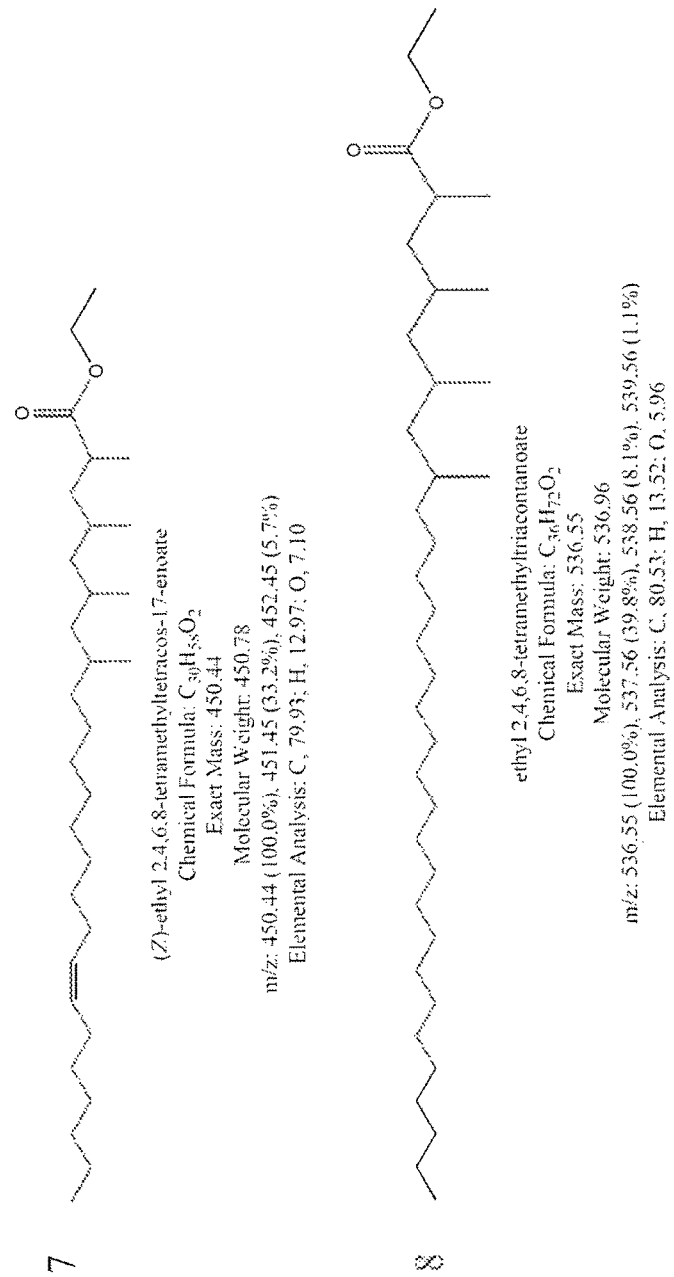

The MMBFA ester products in the bioconversion assays described above were detected as in the LC-MS experiments as ammonium adducts and/or protonated ions in the range of 12.1-16.9 minutes in the chromatography runs. The products identified included, for example, octyl 2,4,6,8-tetramethyltetracosanoate; (Z)-octyl 2,4,6,8-tetramethylhexacos-17-enoate; (Z)-octyl 2,4,6,8-tetramethyltetracos-17-enoate; octyl 2,4, 6,8-tetramethyltriacontonoate; ethyl 2,4,6,8-tetramethyltetracosanoate; (Z)-ethyl 2,4,6,8-tetramethylhexacos-17-enoate; (Z)-ethyl 2,4,6,8-tetramethyltetracos-17-enoate; ethyl 2,4, 6,8-tetramethyltriacontanoate; pentyl 2,4, 6,8-tetramethyltetracosanoate; (Z)-pentyl 2,4,6,8-tetramethylhexacos-17-enoate; (Z)-pentyl 2,4,6,8-tetramethyltetracos-17-enoate; pentyl 2,4,6,8-tetramethyltriacontonoate; butyl 2,4,6,8-tetramethyltetracosanoate; (Z)-butyl 2,4,6,8-tetramethylhexacos-17-enoate; (Z)-butyl 2,4,6,8-tetramethyltetracos-17-enoate; and butyl 2,4,6,8-tetramethyltriacontonoate. The main identified species are summarized in TABLE 5. The structures of the products listed in TABLE 5 as well as the structures of additional identified products are shown in FIGS. 7A-C.

TABLE 5

Major Products Identified by LC-MS.

| N° | Chemical formula | Number of methyl branches | Mass | [M + NH$_4$]$^+$ | [M + H]$^+$ | Retention time (min) |
|---|---|---|---|---|---|---|
| 1 | $C_{38}H_{74}O_2$ | 4 | 562.99 | 580.6 | 563.5 | 16.9 |
| 2 | $C_{35}H_{68}O_2$ | 3 | 520.91 | 538.5 | 521.5 | 15.1 |
| 3 | $C_{32}H_{62}O_2$ | 2 | 478.83 | 496.5 | 479.4 | 13.7 |
| 4 | $C_{29}H_{56}O_2$ | 1 | 436.75 | 454.4 | 437.4 | 12.1 |
| 5 | $C_{36}H_{72}O_2$ | 4 | 536.96 | 554.6 | 537.5 | 16.5 |

Example 2

Improved Multi-Methyl Branched Wax Ester and/or Multi-Methyl Branched Fatty Acid Production Yields 1. Construction of MB02 a FADR-FADE Derivative of MB01

The production of MMBFAs and their derivative wax esters by MAS comprises the utilization of medium to long chain fatty acids as "starter" molecules. To provide elevated levels of these substrates, the *E. coli* native fatty acid degradation pathway was disrupted (this disruption can take place, e.g., by deletion of fadE) and the uptake of exogenous fatty acids was induced (this induction can take place, e.g., by deletion of fadR).

*E. coli* strain MB01' was constructed by P1-mediated transduction of ΔfadE::kan from the JW5020-1 strain (Keio Collection) into MB01 (see TABLE 2). The kanamycin resistance cassette (kan) was subsequently removed through the FLP recombinase as described by Datsenko and Wanner (2000). The deletion was verified by PCR analysis using primers flanking the deleted region.

*E. coli* strain MB02 was constructed by P1-mediated transduction of ΔfadR::kan from the JW1176-1 strain (Keio Collection) into MB01' with the subsequent removal of the kan insert (see TABLE 2). fadR deletion was verified by PCR analysis using primers flanking the corresponding deleted region.

2. Overexpression of *E. coli* ACC/TESA'

Another strategy to increase the endogenous levels of medium to long chain fatty acids as "starter" molecules was up-regulating the native *E. coli* fatty acid biosynthesis pathway. To achieve this up-regulation, an efficient producer of fatty acids was engineered using two distinct genotypic alterations, namely, (i) increasing the supply of malonyl-CoA by over-expressing native ACC, and (ii) releasing feedback inhibition caused by long-chain fatty acyl-ACPs through over-expression of an endogenous thioesterase (tesA'). These genes can be cloned in expression vectors under a variety of inducible promoters known in the art, for example, plac, pgal, ptac, para, or pT7), and each derivative plasmid can be introduced in the *E. coli* MBxx strains disclosed herein (the term MBxx strain refers to any one of the engineered microorganism strains disclosed herein, e.g., *E. coli* strain MB01, MB01', or MB02). In particular, in order to overexpress TesA' in *E. coli*, the tesA' gene was cloned under the T7 promoter in the integrative pAH162 vector backbone. Integration of this vector into the *E. coli* genome was confirmed by PCR of the obtained clones as described by Haldimann et al. *Journal of bacteriology* 183, 6384-6393 (2001). The MBxx derivative strain harboring a unique copy of T7prom-tesA' integrated into φ80 attB sequence was named MB03.

3. Construction of Different Pathways to Synthesize Methylmalonyl-CoA: Improvement of Methylmalonyl-CoA Production in *E. coli*

Production of MMBFAs and their derivative wax esters can be augmented, for example, by increasing the production of methylmalonyl-CoA within the cell. To increase the production of methylmalonyl-CoA within the cell several approaches are used:

(1) Competing pathways are deleted, for example, methylmalonyl-CoA degradation is prevented by the deletion of ygfG (methylmalonyl-CoA decarboxylase) and/or the deletion of ygfH (propionyl-CoA:succinate CoA transferase); and/or, (2) Carbon flow to the production of methylmalonyl-CoA precursor is enhanced, for example, through increases in propionyl-CoA and/or succinil-CoA intermediates. Propionyl-CoA levels are mediated, for example, by propionate ligase-propionyl-CoA carboxylase. Succinil-CoA levels are mediated, for example, by methylmalonyl-CoA mutase-methylmalonyl-CoA epimerase.

In the recombinant strains described in the previous examples, the ygfG gene was deleted. As other step to rationally improve the methylmalonyl-CoA levels, a new derivative strain was generated where the ygfH gene was also disrupted. This was accomplished through P1 transduction of the ygfH::kan mutant allele from *E. coli* ECK2916 (Baba et al., 2006) to *E. coli* MB03. The kan cassette was subsequently removed using FLP recombinase as described by Datsenko and Wanner (2000), thus yielding *E. coli* strain MB04 (see TABLE 6).

*E. coli* MB01 strain, described above, contains an exemplary propionyl-CoA carboxylase (EC 6.4.1.3) from *Streptomyces coelicolor*. The cell was engineered to produce the PCC complex, which comprises the AccA1, PccB and PccE proteins. Our previous studies determined that the PccE protein was necessary to enhance the carboxylase activity of PCC complex. Accordingly, the amount of methylmalonyl-CoA extender units can be increased by culturing the cells in a media supplemented with propionate. Additional non-limiting examples of polypeptides that can be used to catalyze that conversion of propionyl-CoA to methylmalonyl-CoA are carboxylases from *Mycobacterium smegmatis*, *Homo sapiens*, *Acinetobacter baumannii*, *Brucella suis*, or *Burkholderia glumae*.

As noted above, another biochemically-relevant pathway involving methylmalonyl CoA formation is the methylmalonyl CoA mutase pathway, that includes the enzymes methylmalonyl CoA mutase (EC 5.4.99.2) and methylmalonyl CoA epimerase (EC 5.1.99.1). This pathway includes the conversion of succinyl CoA to (R)-methylmalonyl CoA through the action of methylmalonyl CoA mutase (EC 5.4.99.2) followed by the conversion of (R)-methylmalonyl CoA to (S)-methylmalonyl CoA through the action of methylmalonyl CoA epimerase (5.1.99.1).

Accordingly, cells are engineered to overexpress methylmalonyl CoA mutase (mutAB genes) from *Propionibacterium shermanii*, the btuR gene (encoding for cobalamin adenosyltransferase) from *E. coli*, and a methylmalonyl CoA epimerase gene (SCO5398) from *S. coelicolor* (see Dayem et al., Biochemistry 41:5193-5201, 2002). The bioconversion cultures for these derivatives strains include succinate and hydroxocobalamin. Exemplary metylmalonyl-CoA mutases include, but are not limited to mutases from *S. cinnamonensis*, *Corynebacterium glutamicum*, *Homo sapiens*, *Bacullis megaterium*, or *M. smegmatis*. Suitable methyl-malonyl-CoA epimerases include but are not limited to epimerases from *S. sviceus* ATCC29083, *Homo sapiens*, *Bacillus megaterium*, or *M. smegmatis*. See also, Australian Patent Application No. AU 2003/253949 A1, and U.S. Pat. No. 7,291,486 and U.S. Pat. No. 7,011,959, all of which are herein incorporated by reference in their entireties.

TABLE 6

E. coli strains engineered for improved MMBFAs and/or MMBFA wax ester production

| Strain | Engineered Plasmid |
| --- | --- |
| MB01 | BAP1 ygfG::T7prom-accA1-T7prom-pccB-T7-pccE-T7term |
| MB01' | BAP1 ygfG::T7prom-accA1-T7prom-pccB-T7-pccE-T7term ΔfadE |
| MB02 | BAP1 ygfG::T7prom-accA1-T7prom-pccB-T7-pccE-T7term ΔfadE ΔfadR |
| MB03 | BAP1 ygfG::T7prom-accA1-T7prom-pccB-T7-pccE-T7term ΔfadE ΔfadR attB$_{\varphi80}$::T7prom-tesA' |
| MB04 | BAP1 ygfG::T7prom-accA1-T7prom-pccB-T7-pccE-T7term ΔfadE ΔfadR attB$_{\varphi80}$::T7prom-tesA'ΔygfH |

Example 3

Identification of Suitable Thioesterase Enzymes for Production of Free MMBFAs in E. coli Since mycocerosic acids in M. tuberculosis are not actively released from the MAS protein, the final step in the assembly of phthiocerol dimycocerosate (PDIM) requires esterification of mycocerosic acids onto the hydroxyl group of a phthiocerol intermediate. This reaction is carried out by PAPA5 in a direct transfer of the mycocerosic acids-APC from MAS to the acceptor diol. Accordingly, a functional thioesterase capable of hydrolyzing mycocerosic-ACP thioester bond leading to the release of free mycoserosic acids must be identified. For this purpose, diverse thioesterase candidate genes are overexpressed in the E. coli strain MB03/pRT23/pMB07 (Faal28-Mas) and whether the enzyme is active in releasing free mycocerosic acids is determined. Exemplary but not limiting assayed genes include mammary thioesterase II from rat, human fatty acid synthase thioesterase domain, CrTE from Chlamydomonas reinhardtii, the TE domain from PksA from Aspergillus flavus, or tesA5 from M. tuberculosis. See, e.g., Cantu et al. (2010) Protein Sci. 19:1281-1295.

Example 4

Production of MMBFA Esters with Different Chemical Formulas in E. coli

1. Feeding of MB03 Strain with Different Classes of Alcohols in Combination with Different Chain Length Fatty Acids The heterologous production of MMBFA esters by the Faal28-MAS-PapA5 pathway comprises the utilization of medium to long chain fatty acids as "starter" molecules, and short to long chain alcohols as "acceptor" molecules. Primarily, the chemical formula of the product synthesized relies on the nature of the substrates utilized by FAAL28 and PAPA5.

In order to generate MMBFA esters with different chemical formulas, E. coli strain MB03 bacteria can be fed with different classes of alcohols (for example, branched and lineal primary alcohols, secondary alcohols, tertiary alcohols, and divalent alcohols) and with different chain length saturated and unsaturated fatty acids. Bioconversion assays can be performed using, inter alia, 1-octanol, (+/−) 2-octanol, (R)-(−)2-octanol, 1-nonanol, 1-decanol, (+/−) 2-undecanol, myristil alcohol (1-tetradecanol), palmityl alcohol (1-hexadecanol), stearyl alcohol (1-octadecanol), 1-eicosanol, trans-2-octene-1-ol and DL-3-OH-methyl palmitate. A representative example of a variety of MMBFA esters successfully generated by the feeding of a set of ten different alcohol molecules is shown in FIG. 9.

Different fatty acids were also tested, for example, hexanoic acid, heptanoic acid, octanoic acid, nonanoic acid, decanoic acid, undecanoic acid, dodecanoic acid, lauric acid, myristic acid, palmitic acid, oleic acid, hexadecenoic acid and behenic acid. These assays were carried out in the presence of Brij-58 (1:10 fatty acid:Brij-58) and 10 mM propionate. Different combinations of fatty acids and alcohols lead to different classes of MMBFA esters which could then be resolved by TLC, scrapped from the TLC plate, and identified by LC-MS/MS. MMBFA esters products derived from feeding fatty acids shorter than C8 could not be detected.

2. Utilization of Different MAS-Like Enzymes

The natural MMBFA product synthesized by MAS is 2,4,6,8-tetramethyl C32 fatty acid (mycoserosic acid). In Mycobacterium there exist other PKSs (or "MAS-like" proteins) that synthesize different MMBFAs. Different "MAS-like" enzymes can be expressed in the engineered E. coli MBxx strains (e.g., MB01, MB01', MB02, etc.) disclosed herein to generate a vast variety of products with different number of methyl branches, OH— substituents, chain lengths, and number of unsaturations (thus, products with different chemical properties). For the production of octa- and heptamethyl-branched hydroxy-fatty acids, a pET21(a) derivative vector containing the pks2 gene from Mycobacterium tuberculosis H37Rv under the control of T7-promoter is introduced in the E. coli MB03 strain. PKS2 is responsible for the biosynthesis of phthioceranic and hydroyphthioceranic acids in M. tuberculosis.

Phthioceranic and hydroyphthioceranic acids are octamethyl- and heptamethyl-branched fatty acids esterified to sulfothrealose in sulfolipid-I, the most abundant sulfolipid in the cell wall of M. tuberculosis. The final octamethyl- or heptamethyl-branched fatty acid is not actively released from the ACP domain of PKS2. Thus, in order to obtain the free MMBFA, coexpression of PKS2 with different thioesterases is carried out. The thioesterases initially tested (expressed from a compatible plasmid, for example, pBAD33) are mammary thioesterase II from rat, human fatty acid synthase thioesterase domain, CrTE from Chlamydomonas reinhardtii, TE domain from PksA from Aspergillus flavus, and tesA5 from M. tuberculosis. Other candidate thioesterases can be obtained from sources readily available to one skilled in the art. See, e.g., Cantu et al. (2010) Protein Sci. 19:1281-1295.

To generate MMBFAs with a smaller number of branches, a pET21(a) derivative vector containing the pks5 gene from Mycobacterium smegmatis under the control of T7-promoter is introduced in the E. coli MB03 strain. PKS5 is responsible for the biosynthesis of 2,4-dimethyl-2-eicosenoic acid in M. smegmatis. This 2-unsaturated dimethyl-branched fatty acid is one of the components of the major form of lipooligosaccharide (LOS) present in the cell wall of M. smegmatis, LOS-A. The pks5 gene is amplified by PCR from M. smegmatis genomic DNA and cloned into a pET21(a) vector. In order to release the dimethyl-branched fatty acid from the ACP domain of PKS5, this enzyme is coexpressed in combination with pBAD33 derivatives carrying the genes of the different thioesterases detailed above.

PKS3/4 from M. tuberculosis is also assayed. This enzyme is responsible for the biosynthesis of mycolipenic (2,4,6-trimethyl-trans-2-tetracosenoic), mycolipodienic and mycosanoic acid synthesis.

3. Production of MMBFA Esters in *E. coli* Through the Engineered Pathways FAAL-PKS-TE-DGAT.

In order to generate MMBFA esters and triglycerides, the MMBFAs generated by MAS, PKS2 or PKS5 proteins are released from their respective ACP domains by a thioesterase as described above, and subsequently activated by endogenous *E. coli* acyl-CoA synthase (FadD). These acyl-CoAs are then taken as substrates by heterologous expressed ester synthase (WS) or acyl-coenzyme A: diacylglycerol acyltransferase (DGAT).

To accomplish this, various WS and DGAT candidate genes are cloned in pET28(a) vectors under the control of a T7 promoter. These vectors are subsequently introduced in engineered *E. coli* MBxx strains (e.g., MB01, MB01', MB02, etc.) disclosed herein. Accordingly, the resulting MBxx strains carry the genes faal28, mas, and TE. Assayed genes are, for example, the WS atfA from *Acintobacter baumanii*, the DGAT SCO958 from *Streptomyces coelicolor*, and DGAT genes from *Marinobacter hydrocarbonoclasticus* and *Mycobacterium fortuitum*. The different classes of MMBFA esters generated by the engineered strains are resolved by TLC, scrapped from the the TLC plate, and identified by LC-MS/MS.

Example 5

Complete De Novo Synthesis of MMBFA Esters in *E. coli* Strain MB04

1. Construction of a Fatty Alcohol Biosynthesis Pathways

To circumvent the need of an exogenous alcohol supply, we engineered into our MMBFA ester producer strain MB04, three different pathways for the de novo synthesis of fatty alcohol acceptor molecules:

(i) Pathway 1—Includes FAR from *Marinobacter aquaeolei* VT8, which catalyzes the two step reduction of a fatty acyl-CoA to a fatty alcohol (see Willis et al., Biochemistry 50:10550-58 (2011) and Hofvander et al., FEBS Letters 585:3538-43 (2011), which are herein incorporated by reference in their entireties);

(ii) Pathway 2—Includes CAR from *Mycobacterium tuberculosis*, an ortholog of *Mycobacterium marinum* carboxylic acid reductase (see Akhtar et al., Proc. Natl. Acad. Sci. USA 110: 87-92 (2013) which is herein incorporated by reference in its entirety); and, (iii) Pathway 3—Includes Acr1 from *Acinetobacter* spp. strain ADP1, reported as medium-chain acyl-CoA reductase (see Reiser et al., Journal of Bacteriology 179:2969-75 (1997) and Waltermann et al., Biochimie 89:230-42 (2007), which are herein incorporated by reference in their entireties).

The MB04 strain harbors the gene encoding *E. coli* TesA' (a leaderless version of a periplasmic thioesterase) under the control of T7 promoter. It is known that TesA' hydrolyses the acyl-ACP pools, deregulating fatty acid biosynthesis and leading to an increase of free fatty acids pools in the cell (see Cho et al., J. Biol. Chem. 270: 4216-19 (1995)), which can then become available to the reducing enzymes to produce the corresponding fatty aldehydes or fatty alcohols. Given that CAR and Acr1 generate a fatty aldehyde as a product, each of these enzymes was overexpressed together with Ahr, a previously described *E. coli* aldehyde reductase (Akhtar et al., Proc. Natl. Acad. Sci. USA 110: 87-92 (2013)).

Successful de novo production of multi methyl-branched wax esters (MBW) was achieved by expression of either FAR or CAR-Ahr pathways into our MB04 producer strain. In both cases the major MMBFA Esters were identified as (Z)-octyl 2,4,6,8-tetramethylhexacos-19-enoate, (Z)-decyl 2,4,6,8-tetramethylhexacos-19-enoate, (Z)-dodecyl 2,4,6,8-tetramethylhexacos-19-enoate, (Z)-tetradecyl 2,4,6,8-tetramethylhexacos-19-enoate, (Z)-hexadecyl 2,4,6,8-tetramethylhexacos-19-enoate, (Z)-octadecenyl 2,4,6,8-tetramethylhexacos-19-enoate. The MMBFA Esters synthesized by the condensation of each alcohol moiety described above, with the MMBFA Esters derived from Mas-catalyzed extension steps of palmitoleic and palmitic acid, could also be detected.

Conversely, expression of Acr1-Ahr did not show detectable MMBFA sters synthesis. Altogether, these results demonstrated that by expressing different fatty alcohol biosynthesis pathways, our MMBFA Esters producer strain was able to synthesize de novo a structurally diverse set of MMBFA Esters directly from a simple carbon source and propionate.

The fatty alcohol biosynthesis from fatty acyl-ACPs substrates can be achieved, for example, by engineering three catalytic steps that comprise the subsequent action of a (a) thioesterase, (b) an acyl-CoA synthase, and (c) a fatty acyl-CoA reductase.

Exemplary thioesterases used in the engineered fatty alcohol biosynthetic pathway include BTE from *Umbellularia californica*, tesA' from *E. coli*, and TE from *Cinnamonum camphorum*.

Exemplary acyl-CoA synthases include FadD from *E. coli*, FadD1 from *S. coelicolor*, and FAA2 from *Sacharomyces cerevisiae*.

Exemplary fatty acyl-CoA reductases include Acr1 from *Acinetobacter* ADP1, FAR from *Marinobacter aquaeolei* VT8, FARs from *Arabidopsis thaliana*, and FCR1 (Rv3391) and FCR2 (Rv1543) from *M. tuberculosis*.

Exemplary carboxylic acid reductases include CAR (Rv2590) from *Mycobacterium tuberculosis* and CAR from *Mycobacterium marinum* Exemplary aldehyde reductases include Ahr (YjgB) from *E. coli* and AHR (slr1192) from *Synechocystis* species PCC 6803.

Each of the genes involved in fatty alcohol biosynthetic production are coexpressed in the *E. coli* MB04 strain. Thus, this recombinant strain carries the FAAL-PKS-PapA system in addition to a thioesterase, and (1) an acyl-CoA synthase, a fatty acyl-CoA reductase, and a fatty aldehyde reductase, or (2) a carboxylic acid reductase and a fatty aldehyde reductase.

2. Construction of Short Chain Alcohol Biosynthesis Pathway

The production of short-chain alcohols (e.g., ethanol, butanol, isopropanol) from fermentative pathways; and the production of short-chain to medium alcohols (e.g., propanol, butanol, 2-methyl-butanol, 3-methyl-butanol) from 2-keto acid pathways in *E. coli* are well known in the art.

MMBFA ester-producing strains can be engineered by introducing genes encoding proteins responsible for the biosynthesis of short to medium chain alcohols. The engineered strains can biosynthesize the alcohol moiety necessary for the esterification of MMBFAs, thus obviating the need to provide an exogenous alcohol source to the cells. Ethanol production can also be achieved by the expression of the *E. coli* mutant alcohol dehydrogenase (adhE$^{mut}$). See Yong et al., Nature 502:571 (2013).

Accordingly, we engineered *E. coli* strain MB04 for the endogenous production of ethanol and its further use for the biosynthesis of the corresponding multimethyl branched ethyl esters. Ethanol production was achieved in *E. coli* upon heterologous expression of pyruvate decarboxylase (the pdc gene product) and alcohol dehydrogenase (the adhB gene product) from the strictly anaerobic ethanologenic Gram-negative bacterium *Zymomonas mobilis*. The pdc and the adhB genes were cloned in an operon fashion under the T7 promoter in a pET22b plasmid. Production of multimethyl branched ethyl esters is detected by TLC and confirmed by LC/MS/MS.

Example 6

Production of MMBFA Esters in *Streptomyces*

Triacylglycerol accumulation has been described in various species of the genera *Mycobacterium, Streptomyces, Rhodococcus*, and *Nocardia*. This particular characteristic indicates their high capacity of actively synthesize fatty acids for carbon and energy reserve. Since the synthesis of MMBFA esters comprises the use of fatty acid as starters by the MAS protein, microorganism from the *Streptomyces, Rhodococcus*, and *Nocardia* genera can be selected for the production of multimethyl-branched fatty acids and their esters.

*Streptomyces coelicolor*, was selected as model organisms, and the MAS, FAAL28 and PAPA5 proteins were overexpressed in this organism as described in the instant application.

For *S. coelicolor*, genes coding for the MAS, FAAL28 and PAPA5 proteins were cloned under the promoter $P_{ermE*}$ (constitutive) yielding plasmid pMB22. This plasmid was introduced into *S. coelicolor* by conjugation and selected for its integration into the ΦBT1 attachment site. As described above, triglycerides constitute the major sink for the excess of fatty acids in *S. coelicolor*. The final step of triglyceride biosynthesis in *S. coelicolor* is catalyzed by the diacylglycerol:acyl transferase (DGAT) codified by SCO0958 gene. Accordingly, the genes coding for the MAS, FAAL28 and PAPA5 proteins in the constructs mentioned above were introduced in a *S. coelicolor* SCO0958 mutant strain, where triglyceride synthesis is significantly reduced compared to wild-type strain. Since fatty acids cannot be converted to triglycerides in the mutant strain, de novo synthesized fatty acids are shunted into the MMBFA biosynthetic pathway. Production of MMBFA Esters were detected by TLC analysis.

For *R. opacus*, the genes coding for the MAS, FAAL28 and PAPA5 proteins are cloned under the promoters $P_{groEL*}$ (constitutive) and $P_{ace}$ (inducible) to yield plasmids pMB24 and pMB25, respectively. Each plasmid is introduced by electroporation of the corresponding replicative plasmids into a wild-type and into an atf1 (diacylglycerol:acyl transferase coding sequence) mutant strain. Production of MMBFA Esters is detected in the strains generated by TLC.

For *M. smegmatis*, the genes coding for the MAS, FAAL28 and PAPA5 proteins (cloned in plasmids pMB24 and pMB25) are introduced by electroporation of the corresponding replicative plasmids into a wild-type strain. Production of MMBFA Esters is confirmed by TLC analysis.

The strains generated were cultivated in their respective media and supplemented with propionate and octanol as described above for *E. coli* experiments.

Example 7

Production of Free MMBFAs in *Streptomyces* and *Rhodococcus*

1. Introduction of FAAL-MAS-TE into *S. coelicolor* WT

As we already mentioned, the product of MAS protein is a MMBFA, which is esterified to a thiol group in the MAS protein's ACP domain. The acyl group is normally transesterified to an alcohol, in a reaction catalyzed by the PAPA5 protein. However, in order to obtain the free methyl-branched fatty acid, it is necessary to hydrolyze the thioester bond by the action of a thioesterase.

To achieve this goal in *S. coelicolor*, the genes coding for MAS, FAAL28 and thioesterases (described above) are cloned under the promoters $P_{ermE*}$(constitutive) and tcp830 (inducible). The genes are introduced by integration to the ΦBT1 and ΦC31 phage attachment sites of a wild-type strain.

The coexpression of this set of proteins is also performed in *R. opacus*, driving their expression by the promoters $P_{groES*}$(constitutive), $P_{tipA}$ (inducible) and $P_{ace}$ (inducible). The corresponding replicative plasmids are introduced by electroporation in a wild-type strain.

Since triglycerides represent an important sink for fatty acids, the genes coding for DGAT of each organism (SCO0958 for *S. coelicolor*, and atf1 for *R. opacus*, respectively) are mutated in order to increase the titers of free fatty acids.

The strains generated by these procedures are cultivated in their respective media and supplemented with propionate as described above for *E. coli* experiments.

Example 8

Generation of Triacylglycerols (TAGs) with MMBFAs in *S. coelicolor* and in *R. opacus*

1. Introduction of FAAL-MAS-TE and a Diacylglycerol Acyltransferase (DGAT) with Higher Affinity for MMBFA-CoAs Actinomycetes have the ability of synthesize triglycerides by using endogenous glycerol-3-phosphate (G3P) and fatty acids. Accordingly, the MMBFAs generated in the engineered strains disclosed herein can be further used by native or engineered G3P acyltransferases, lysophosphatidic acyltransferases, or diacylglycerol:acyl transferases to generate triglycerides containing methyl-branched acyl moieties.

To achieve this goal in *S. coelicolor*, the genes coding for MAS, FAAL28, and thioesterases are cloned under the promoters $P_{ermE*}$(constitutive) and tcp830 (inducible). The genes are subsequently introduced by integration to the ΦBT1 and ΦC31 phage attachment sites of a wild type strain.

The co-expression of this set of proteins is also performed in *R. opacus*. In these organisms, the expression of genes coding for MAS, FAAL28, and thioesterases is driven by the promoters $P_{groES*}$(constitutive), $P_{tipA}$ (inducible) and $P_{ace}$ (inducible), respectively, which are introduced by electroporation of the corresponding replicative plasmids in a wild-type strain.

In order to optimize the incorporation of the non-native methyl-branched fatty acid into the TAG fraction, the expression of foreign DGATs is tested in *S. coelicolor* and *R. opacus* strains with the MAS/FAAL28/thioesterase genetic background described above. For this purpose, DGAT genes from *Marinobacter hydrocarbonoclasticus* DSM 8798 and *Mycobacterium fortuitum* are selected, since it has been previously reported that they can utilize branched molecules as substrates.

The resulting strains are cultivated in their respective media and supplemented with propionate as described above for *E. coli* experiments.

Example 9

Production of MMBFA and MMBFA Esters in Yeast

Robustness towards contaminations, high alcohol tolerance, and low pH tolerance make yeast in general, and *Saccharomyces cerevisiae* in particular very good choices for fermentation at industrial scale. Accordingly, MMBFAs and their esters are produced in this host. Different pathway engineering strategies can be used to produce MMBFAs and their esters in yeast, e.g., in *Saccharomyces cerevisiae*. Two such examples are (i) *Saccharomyces cerevisiae* strains containing FAAL28, MAS, and PAPA5, and (ii) *Saccharomyces cerevisiae* strains containing FAAL28-MAS-TE.

To generate the FAAL28-MAS-PAPA5 strains, genes coding for MAS, FAAL28 and PAPA5 proteins are cloned under the promoters $P_{GPD}$ (constitutive), $P_{ADH1}$ (constitutive) and $P_{GAL1}$ (inducible), and introduced by (i) electroporation of the corresponding replicative plasmids, and/or (ii) integration in the host chromosome. The generated strains are cultivated in the respective cell culture media and supplemented with propionate and different alcohols as described above for *E. coli* experiments.

To generate the FAAL28-MAS-TE strains, the production of MMBFAs in this host is achieved by coexpression of MAS, FAAL28 and thioesterase enzymes by using promoters $P_{GPD}$ (constitutive), $P_{ADH1}$ (constitutive) and $P_{GAL1}$ (inducible). Subsequently, the genes are introduced in the host cell by electroporation of the corresponding replicative plasmids, or by integration in the host chromosome. The generated strains are cultivated in their respective cell culture media and supplemented with propionate as described above for *E. coli* experiments.

In *S. cerevisiae* the last steps of triglyceride biosynthesis are catalyzed by the enzymes phosphatidic acid phosphatase and diacylglycerol acyltransferase (DGAT), codified by the pah1 and dga1 genes, respectively. Since triglycerides constitute a major sink for fatty acids, the constructs mentioned above are introduced into a pah1 and/or a dga1 knockout mutant strains. See, e.g., Yen et al. (2008) J. Lipid Res. 49:2283-301; Turchetto-Zolet et al. (2011) BMC Evol. Biol. 11:263; Liu et al. (2012) Prog. Lipid Res. 51:350-77.

The present invention has been described above with the aid of functional building blocks illustrating the implementation of specified functions and relationships thereof. The boundaries of these functional building blocks have been arbitrarily defined herein for the convenience of the description. Alternate boundaries can be defined so long as the specified functions and relationships thereof are appropriately performed.

The foregoing description of the specific embodiments will so fully reveal the general nature of the invention that others can, by applying knowledge within the skill of the art, readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

The breadth and scope of the present invention should not be limited by any of the above-described exemplary embodiments, but should be defined only in accordance with the following claims and their equivalents.

The claims in the instant application are different than those of the parent application or other related applications. The Applicant therefore rescinds any disclaimer of claim scope made in the parent application or any predecessor application in relation to the instant application. The Examiner is therefore advised that any such previous disclaimer and the cited references that it was made to avoid, may need to be revisited. Further, the Examiner is also reminded that any disclaimer made in the instant application should not be read into or against the parent application.

---

SEQUENCE LISTING (100 sequences)

SEQ ID NO: 1 - protein, 383 aa, Mycobacterium tuberculosis
LVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGRLVDAPLPAWTHARLFIDDDGQEQRAQGA

SEQ ID NO: 2 - protein, 430 aa, Mycobacterium tuberculosis
VAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHASVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDHTPKRVAVSSFGMSGTNVHAIVEEAPAEASAPE

SEQ ID NO: 3 - protein, 2111 aa, Mycobacterium tuberculosis
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHASVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDHTPKRVAVSSFGMSGTNVHAIVEEAPAEASAPESSPGDAEVGPRLFMLSSTSSDALRQTARQLATWVEEHQDCVAASDLAYTLARGRAHRPVRTAVVAANLPELVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDITFEQMLLLDEQTPIDAVASIDAPGVVNFTVETNRDGETTRHATAALRAAEDDCPPPGYDITALLQAHPHAVNGTAMRESFAERGVTLGAAFGGLTTAHTAEAGAATVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDEHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQIEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPDRVRELLATVFKLTADGVLTAPQCTHYPLAEAADAIRAMSNAEHTGKLVLDVPRSGRRSVAVTPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQRSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 4 - protein, 2111 aa, Mycobacterium bovis
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHACVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDHTPKRVAVSSFGMSGTNVHAIVEEAPAEASAPESSPGDAEVGPRLFMLSSTSSDALRQTARQLATWVEEHQDCVAASDLAYTLARGRAHRPVRTAVVAANLPELVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDITFEQMLLLDEQTPIDAVASIDAPGVVNFTVETNRDGETTRHATAALRAAEDDCPPPGYDITALLQAHPHAVNGTAMRESFAERGVTLGAAFGGLTTAHTAEAGAATVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDEHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQIEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPDRVRELLATVFKLTADGVLTAPQCTHYPLAEAADAIRAMSNAEHTGKLVLDVPRSGRRSVAVTPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQRSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 5 - protein, 2111 aa, Mycobacterium tuberculosis
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHASVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDHTPKRVAVSSFGMSGTNVHAIVEEAPAEASAPESSPGDAEVGPRLFMLSSTSSDALRQTARQLATWVEEHQDCVAASDLAYTLARGRAHRPVRTAVVAANLPELVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGWLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDITFEQMLLLDEQTPIDAVASIDAPGVVNFTVETNRDGETTRHATAALRAAEDDCPPPGYDITALLQAHPHAVNGTAMRESFAERGVTLGAAFGGLTTAHTAEAGAATVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDEHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQIEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPDRVRELLATVFKLTADGVLTAPQCTHYPLAEAADAIRAMSNAEHTGKLVLDVPRSGRRSVAVTPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQRSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 6 - protein, 2111 aa, Mycobacterium tuberculosis
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHASVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKVILSLRHGVVPPLLHFNRLPDELSDVETGLFVPQAVTPWPNGNDHTPKRVAVSSFGMSGTNVHAIVEEAPAEASAPESSPGDAEVGPRLFMLSSTSSDALRQTARQLATWVEEHQDCVAASDLAYTLARGRAHRPVRTAVVAANLPELVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDITFEQMLLLDEQTPIDAVASIDAPGVVNFTVETNRDGETTRHATAALRAAEDDCPPPGYDITALLQAHPHAVNGTAMRESFAERGVTLGAAFGGLTTAHTAEAGAATVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDEHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQIEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPDRVRELLATVFKLTGDGVLTAPQCTHYPLAEAADAIRAMSNAEHTGKLVLDVPRSGRRSVAVTPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQRSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 7 - protein, 2111 aa, Mycobacterium tuberculosis
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHASVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASTGTVGLIKAILSLRHGVVPPLLHFNRLPDELSDVETGLFVPQAVTPWPNGNDHTPKRVAVSSFGMSGTNVHAIVEEAPAEASAPESSPGDAEVGPRLFMLSSTSSDALRQTARQLATWVEEHQDCVAASDLAYTLARGRAHRPVRTAVVAANLPELVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDITFEQMLLLDEQTPIDAVASIDAPGVVNFTVETNRDGETTRHATAALRAAEDDCPPPGYDITALLQAHPHAVNGTAMRESFAERGVTLGAAFGGLTTAHTAEAGAATVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDGHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQIEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPDRVRELLATVFKLTADGVLTAPQCTHYPLAEAADAIRAMSNAEHTGKLVLDVPRSGRRSVAVTPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQRSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 8 - protein, 2111 aa, Mycobacterium canettii
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEADLALAGGCAVLLEPHASVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDHTPKRVAVSSFGMSGTNVHAIVEEAPAEASAPESSPGDAELGPRLFMLSSTSSDALRQTARQLATWVEEHQDGVAASDLAYTLARGRAHRPVRTAVVAANLPELVEGLREVADGDALYDAAVGHGDRGPVWVFSGQGSQWAAMGTQLLASEPVFTATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSETVRDLIARWEQRDVMAREVAVDVASHSPQVDPILDDLAAALADIAPMTPKVPYYSATLFDPREQPVCDGAYWVDNLRNTVQFAAAVQAAMEDGYRVFAELSPHPLLTHAVEQTGRSLDMSVAALAGMRREQPLPHGLRGLLTELHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDIAFEQMLLLDEQTPIDAIASIDAPGVVNFTVETNRDGETTRHATAALRAAEDDCPPPGYDITALLQAHPHAVNGTAMRESFAERGVTLGAAFGGLTTAHTAEAGAATVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDRPPNDQAGLEKLGSQLRGRDGVVIVYGPRVGDPDEHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVAPGPGQLEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPDRVRELLATVFKLTADGVLTAPQCTHYPLAEAADAIRAMSNAEHTGKLVLDVPRSGRRSVAVPPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQGSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 9 - protein, 2111 aa, Mycobacterium canettii
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGEVDLALAGGCAVLLEPHASVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDDTPKRVAVSSFGMSGTNVHAIVEEAPAEASAPESSPGDAQVGPRLFMLSSTSSDALRQTARQLATWVEEHQDCVAASDLAYTLARGRAHRPVRTAVVAANLPELVEGLREVADGDALYDAAVGQGDRGPVWVFSGQGSQWAAMGTQLLASEPVFAATIAKLEPVIAAESGFSVTEAITAQQTVTGIDKVQPAVFAVQVALAATMEQTYGVRPGAVIGHSMGESAAAVVAGALSLEDAARVICRRSKLMTRIAGGGAMGSVELPAKQVNSELMARGIDDVVISVVASPQSTVIGGTAETVRDLIARWEQRDVMAREVAVDVASHSPQVDPILDDLAAALADIAPMTPKVPYYSATLFDPRERPVCNGAYWVDNLRNTVQFAAAVQAAMEDGYRVFAELSPHPLLTHAVEQTARNLDMSVAALAGMRREQPLPHGLRGLLTDLHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDIAFEQMLLLDEQTPIDAVASIDAPGVVTFTVETNQHGETTRHATAALRAAEDDCPPPGYDITALLQAHPHAVNGTAMRESFAERGVTLGAAFGGLTTAHTAEAGAGTVLAEVALPASIRFQQGAYRIHPALLDACFQSVGAGVQAGTATGGLLLPLGVRSLRAYGPTRNARYCYTRLTKAFNDGTRGGEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDEHSLLAGREQVRHLVRITRELAEFEGELPRLFVVTRQAQIVKPHDSGEIANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQLEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLAFGGRFVEIGKADVYGNTRLGLFPFRRGLTFYYLDLALMSVTQPGRVRELLATVFKLTADGVLTAPQCTHYPLVEAADAIRAMSNAEHTGKLVLDVPRSGSRSVAVPPEQAPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWRRAQGLPVSAIAWGAWGEVGRATFLAEGGEIMITPEEGAYAFETLVRHDRAYSGYIPILGAPWLADLVRRSPWGEMFASTGQGSRGPSKFRMELLSLPQDEWAGRLRRLLVEQASVILRRTIDADRSFIEYGLDSLGMLEMRTHVETETGIRLTPKVIATNNTARALAQYLADTLAEEQAAAPAAS

SEQ ID NO: 10 - protein, 2099 aa, Mycobacterium haemophilum
METRVTPIAVIGMGCRLPGGINSPDQLWESLLGGDNLVTEVPADRWIADDFYDPEPGVPGRSVSRWGGFLDDVAGFDAEFFGISEREATSIDPQQRLLLETSWEAIEQGGLDPASLAGSSTAVFTGLTHEDYLVLTTAAGGLASPYVVTGLNNSVASGRISHTLGLHGPAMTFDTACSSGLMAVHLACRSLHDGESDLALAGGCAVLLEPHASVAASAQGMLSSSGKCKSFDADADGFVRSEGCAMVLLKRLPDALRDGNRIFAVIRGTATNQDGGTETLMMPSEDAQVAVYRAALAAAGVEPETVSVVEAHGTGTPIGDPIEYRSLARVYGAGTPCALGSAKSNMGHSTASAGTVGLIKAILSLRHGVVPPLLHFNRLPDELSDVETELFVPQAVTPWPNGDGQAPKRVAVSSFGMSGTNVHAIVEEAPAEAATPDAPQTSTGDATAGPRLFMLSATSSDALRETARRLATWVEERQDSVTSSDLAYTLARGRAHRPVRTAVIAADLPELVAGLREVADGDALYDAAVGQGDRGPVWVFSGQGSQWAAMGTQLLASEPVFAATIAKLEPVIAAESGFSVTEAITAQETVTGIAHVQPAVFAVQVALAATMEQTYGVRPGAVIGHSMGESAAAVVAGALSLEDAARVICRRSKLMTRIAGGGAMGSVELPAKQVNSELMARGIDDVVISVVASPQSTVIGGATETVRDLIARWEQRDVMAREVAVDVASHSPQVDPILDDLAAALADIAPMTPKVPYYSATLFDPRERPVFNGAYWVDNLRNTVQFAAAVQAAMEDGYRVFAELSPHPLLTHAVEQTARNLDMSVATLAGMRREQPLPHGLRGLLTDLHRAGAALDFAELYPAGRLLDAPLPVWTHPRLFIDTDGQEQRAQGACTVTVHPLLGSHVRLLEEPERHIWQGDVGTAALAWLADHQVHNVAALPGAAYCEMALAAAVEVFGEAAEVRDIAFEQMLLLDEQTPIDAIASVDAPGVINFMVQANQDGEKTRNATATLHAADDAEGDGPPPAYDIAALLEAHPNSVNGTDMRESFAGRGVQLGAAFAGLATAHTGEAEAGTVLAEVALPASIRFQQSAYHIHPALLDACFQSVGAGVDATKASSKGGLLLPLGVRSLRAYGPTRNARYCYTRLTKIEARGGEADLDVLDEHGTVLLAVRGLHMGTGTTERGELDRQLSERLLTLGWQQRTLPEATHVEPGSWLLIDTANAVDTPDMLASTLTDALKSHGPQGTECANLSWSIQDDPAASREKLGSQLRGRDGVVILYGPRAGDPDEQGLLAGREQVRHLVRITRELAELEGELPRLFIVTRQAQIVQSDDKANLEQAGLRGLLRVISSEHPMLHPTLIDVDEHTDVERVAQQLLSGSEEDETAWRNGDWYVARLTPSPLSHEDRRTVVLNPEHDGMRAHVRKPGDLQSLELVASDRVPPGPGQLEVAVSMSSINFADVLIAFGKFPIIDDREPQLGMDYVGVVTAVGEGVTGHQVGDRVGGFSEGGCWRTFLTCDANLAVTLPSGLTDEQAITAATAHATAWYGLNDLAGIKAGDKVLIHSATGGVGQAAISIARAKGAEIFATAGNPTKRAMLHDMGIEHVYDSRSVKFAEQIRSDTDGYGVDIVLNSLTGAAQRAGLELLAFGGRFVEIGKADVYGNTRLGLFPFRRGLTFYYLDLALMSVTQPDRVRELLATVYQLTADGVLTAPECTHFPLTDAANAIRAMSNAEHTGKLVLDIPRSGSRSVAVPPEQAPVYRRDGSYIITGGLGGLGLFFASKLAEAGCGRIVLTARSQPNPKARQTIERLCEAGADIVVECGNIAEPDTADRLVSAATATGLPLRGVLHSAAVVEDATLTNITDELIDRDWSPKVYGSWNLHRATIGQPLDWFCLFSSGAALLGSPGQGAYAAANSWVDLFAHWRRAQGLPVSAIAWGAWGEVGRATFLAEGGEIMITPDEGAYAFETLVRHDRAYSGYIPILGAPWLPDLVRRSPWGEMFASTGQGSRGPSKFRMELLALPQDEWSGRLRRLLVEQASVILRRTIDADRSFIEYGLDSLGMLEMRTHIESETGIRLTPKVIATNNTARALAQYLADTL

SEQ ID NO: 11 - protein, 2109 aa, Mycobacterium leprae
METSVTPIAVIGMGCRLPGGINSPDKLWESLLRGDNLVTEVPPDRWDVDDFYDPEPGVPGRSVSRWGGFLDDVAGFDAEFFGISEREATSIDPQQRLLLETSWEAIEQGGLDPASLAGSSTAVFTGLTHEDYLVLTTAAGGLASPYVVTGLNNSVASGRISHTLGLHGPAMTFDTACSSGLMAVHLACRSLHDGESDLALAGGCAVLLEPHASVAASAQGMLSSTGRCKSFAADADGFVRSEGCAMVLLKRLPDALRDGNRIFAMILGTATNQDGGTETLMMPSEDAQVAVYQAALAVAGVEPETIGVVEAHGTGTPIGDPIEYRSLARVYGAGTPCALGSAKSNMGHSTASAGTVGLIKAILSLRNGLVPPLLHFDRLSDDLTEIETGLFVPQEVTPWPVGGYNTPKRVAVSSFGMSGTNVHVIVEEAPSEACAPDVPETSPGTGDATVGRQLFMLSSTSIAALRETARQLATWVEEHQDSVVLSDLAYTLARGRAHRPVRTAVVAADLPELVEGLCEIADGDALYDAVVGHGDRGPVWVFSGQGSQWASMGVQLLANEPVFAATITKLEPVIAAESSFSVTEAITAPETVTGIDKVQPSVFAVQVALATTMEQTYGVRPGAVIGHSMGESAAAVVAGALSLEDAARVICRRSKLMNRVAGSGAMGSVELPAKQVNSELMARGIDDVVISVVASPQSTVIGGATETVRDLIAQWEQRDVMAREVAVDVASHSSQVDPILDDLAAALADIAPMTPKVPYYSATLFDPRELPVCNGAYWVDNLRNTVQFAAAVQAAMEDGYRVFAELSPHPLLTHAVEQTARNLDMSVAALAGMRREQSMPYGLRGLLADLHSAGAALDFAALYPAGRLLDAPLPVWTHPRLFIDTDGQEQRAQGACTVTVHPLLGSHVRLLEEPERHIWQGDVGTAALSWLADHQVHNVAALPGAAYCEMALAAAVEVFGEAAEVRAIAFEQMLLLAAETPIDAIASVDAPGVINFVVQANQDGEKMRNATATLHAAEDDCPPPAYDIAALLEAHPNSVNGTDLRESFAERGVQLGAAFAGLATAHTAEAESGTVLAEVALPASIRFQQSSYQIHPALLDACFQSVGAGVDATKVGSRAGLLLPLGVRSLRVYRPTRNARYCYTRLTKIEPRGGEADLDVLDEHGAVLLAVRGLHMGTGTTERGELDRQLSERLLTIGWQQRTLPESVHVEPGSWLLIDTFNASAIPDMWASTLTDALKSYGTQGTECTNLSWLIQDDPVVSRERLGRQLRGRDGVVILCGPRAGAPDEQSLLAAREQVRHLVRIIRELAELEGELPRLFVVTRQAQIVQSGDAANLEQAGLRGLLRVISSEHPMLRTTLVDVDEHTDVERVAQQLLSGSEEDETAWRNGDWYVARLNPSPLSHEDRRTVVLNPEHDGLRVHVRKPGDLQSLELVASDRVPPGPGQLEVAVSMSSINFADVLIAFGRFPIIDDRDPQLGMDFVGVVTAVGEGVTGHQIGDRVGGFSEGGCWRTFLTCDANLAVTLPSGLTDEQAITAATAHATAWYGLNDLAGIKVGDKVLIHSATGGVGQAAISIARAKGAEIFATAGNPTKRAMLHDLGIEHVYDSRSVEFAEQIRRDTDGYGVDIVLNSLTGAAQRAGLELLTFGGRFVEIGKADVYGNTRLGLFPFRRGLTFYYLDLALMSVTQPDRVRELLATVFNLTADGVLTAPECTHYPLTDAANAIRAMSNAEHTGKLVLDIPRTGSRSVAVPPEQAPVYRRDGSYIITGGLGGLGLFFASKLAEAGCGRIVLTARSQPNPKARQTIERLCAAGADIVVECGNIAEPYTADRLVNAATATGLPLRGVLHSAAVVEDATLTNITDELIDRDWSPKVYGSWNLHCATIGQPLDWFCLFSSGAALLGSPGQGAYAAANSWVDLFAHWRRAQGLPVSAIAWGAWGEVGRATFLAEGGEIMITPDEGAYAFEMLVRYDRPYSGYIPILGAPWLPDLVRRSPWAEMFSSAGQGSRGPSKFRMELLALPQDEWSGRLRRLLVEQASVILRRTIDADRSFIEYGLDSLGMLEMRTHIESETGIRLTPKVIATNNTARALAQYLADTLAEEEGVAAPAA

SEQ ID NO: 12 - protein, 2099 aa, Mycobacterium marinum
MQKPATPVAIIGMGCRLPGGVDSPEKLWESLLRGDDLVSEIPPDRWDVDDYYDPEPGVPGRTVSRWGGFIDDVAGFDAEFFGVSEREATSIDPQHRQLLETAWEAIEHAGLDPASLSGSSTGVFVGLSHEDYLVRSVLAGDLAGPYASTGLINSVASGRIAHTLGLHGPAMTVDTACSSGLLTVHLACRSLHEGESDLALAGGCALLLEPNGSVSLSSQGMLSPTGRCHAFDVDADGFVRSEGCAVVVLKRLSDALADGDRILAVVRGTAANQDGRSETLLMPSETAQVAVYREALAAAGVDPASVGAVEVHGTGTPVGDPIEYRSLAQVYGSGGSRCMLGSVKTNIGHSESAAGTVGLIKATLSLGHGVVPPMVHHTRLPDELAEIETGLYVPHEITPWPEDQGPRRIAVSSFGMSGTNVHAILEEPPTPAPARDQAPAEPGMASPLLFALSSTSADGLRQTARELAEWVGSRADSADSTEAVDLAYTLARRRAHRPVRTAVVAASLPELVEGLQEVAEGDLMYEAAVGRGDRGPVWVFSGQGSQWAAMGADLLANEPVFAATVAAVEPIIAHESGFSVTEAMTAPEKVTGIDKVQPTLFAMQVALAATMEKTYGVRPGAVIGHSLGEAAAAVVAGSLSLEDGARVISRRSKLMLRISGAGAMASVELPAKQVNSELMARGIDDVAVAVVASPQSTVVGGATDTVRDLVARWEQREVMAREVAVDVASHSPQVDPILEDLATALADIVPSDPKVPYYSATLFDPRERPTCDAAYWVDNLRNTVQFAAAVQAALEDGFRVFAELSPHPLLTHAVDQNARSLDMSAAALAGMRREQPLPHGLRGLLTDVHSAGAAVDFSVLYPAGRLVNAPLPAWTHRRFFVDGEGQDSKAQGACSVTVHPLLGAHVRLSEQPERHVWQTDVGTDTLSWLSDHQVRNVAALPGAAYCEMALAAAGEVFGEAFEVRDLAFEQMLLLDEETPIDAVASLDSPGAANFVVQTHVDGETTRHATAALRASDDESVPPAYDIAALLAAHPVSVNGAELREAFVERGIQHGPAFSGLAIARTAETEGGTVLAEVALPASIRFQQGAYGVHPALLDACFQSVAAGVKSTGGGGLLLPLGVRSLRAYGPTRNAQYCYTRVTKADANGGEADLELLDEQGCVLLAVRGLRLGTGTSESGERDRVLSERLLTLEWQQRQLPEVLDEETGSWLLISASDGEDLMATMLADALKSQGAECASMVWSAQDDLAGGIEKLGAQLRARTNKGVVIVCGPRSGDADEQSLLQGREQVRHLVRITRELAELEGELPRLFVVTRQAQRVRPEDEINLEQAGLRGLLRVIGSEHPLLQTTQVDVDESTQAEQLAQQLLGGSEEDETAWRGGEWYVARLFPGPLSADERQTTIVDHERDNMRLQIRTPGDLQTLELAACDRVPPGPGQIEVAVTMSSINFADVLIAFGRYPSLEGRLPETGTDFVGVVTAVGEGVTDHQVGDRVGGFSKDGCWRSYLTCDANLAVTLPAGLSDEHAAASSTAHATAWYGLNDLAGIKAGDRVLIHSATGGVGQAAIAIARAAGAQIFATAGNAERRQLLNDMGIEHVYDSRSIEFADQIRRDTNGYGVDIVLNSLTGAAQRAGLELLAFGGRFVEIGKADVYGNTRMGLYPFRRGLTFYYVDLGLMSVIQPERVRELLSTVYNLTAEGVLSAPECTHYPLAEAAEAIRTMSNAAHTGKLLLDMPRSGRRGVVVPPEQVEVFRGDGSYIITGGLGGLGLFFASKMAAAGCGRIVLTARSQPNPKSRQAIERLRANGADIVVECGNIAEPETADRLVSAATATGLPLRGVLHAAAVVEDATLSNITDELIDRDWSPKVYGSWNLHRASTGQPLDWFCLFSSGAALMGSPGQGAYAAANSWVDAFAHWRRAQGLPVCAIGWGAWGEVGRATFLAEGGEIMIAPDEGMYAFEQMLRHARTYTGYIPIIGAPWLADLVRRSPWAEMFQSSGQNTRGPSKFLAELKLLPQEEWAGRLRRLIAEQASVILRRTVDADRPFVEYGLDSLGMLEMRTHIETETGVRLSPKVIASHNTARALSQHLADTLAEEEAQPAAS

SEQ ID NO: 13 - protein, 2099 aa, Mycobacterium ulcerans
MQKSATPVAIIGMGCRLPGGVDSPEKLWESLLRGDDLVSEIPPDRWDVDDYYDPEPGVPGRTVSRWGGFIDDVAGFDAEFFGVSEREATSIDPQHRQLLETAWEAIEHAGLDPASLSGSSTGVFVGLSHEDYLVRSVLAGDLAGPYASTGLINSVASGRIAHTLGLHGPAMTVDTACSSGLLTVHLACRSLHEGESDLALAGGCALLLEPNGSVSLSSQGMLSPTGRCHAFDVDADGFVRSEGCAVVVLKRLSDALADGDRILAVVRGTAANQDGRSETLLMPSETAQVAVYREALAAAGVDAASVGAVEVHGTGTPVGDPIEYRSLAQVYGSGGSRCMLGSVKTNIGHSESAAGTVGLIKATLSLGHGVVPPMVHHTRLPDELAEIETGLYVPHEITPWPEDQGPRRIAVSSFGMSGTNVHAILEEPPTPAPARDQASAEPGMASPLLFALSSTSADGLRQTARELAEWVGSRADSADSTEAVDLAYTLARRRAHRPVRTAVVAASLPELVEGLQEVAEGDLVYEAAVGRGDRGPVWVFSGQGSQWAAMGADLLANEPVFAATVAAVEPIIAHESGFSVTEAMTAPEKVTGIDKVQPTLFAMQVALAATMEKTYGVRPGAVIGHSLGEAAAAVVAGSLSLEDGARVISRRSKLMLRISGAGAMASVELPAKQVNSELMARGIDDVAVAVVASPQSTVVGGATDTVRDLVARWEQREVMAREVAVDVASHSPQVDPILEDLATALADIVPSDPKVPYYSATLFDPRERPTCDAAYWVDNLRNTVQFAAAVQAALEDGFRVFAELSPHPLLTHAVDQNARSLDMSAAVLAGMRREQPLPHGLRGLLTDVHSAGAAVDFSVLYPAGRLVNAPPPAWTHRRFFVDGEGQDSKAQGACSVTVHPLLGAHVRLSEQPERHVWQTDVGTDTLSWLSDHQVRNVAALPGAAYCEMALAAAGEVFGEAFEVRDLAFEQMLLLDEETPIDAVASLDSPGAANFVVQTHVDGETTRHATAALRASDDESVPPAYDIAALLAAHPVSVNGAELREAFVERGIQHGPAFSGLAIARTAETEGGTVLAEVALPASIRFQQGAYGVHPALLDACFQSVAAGVKSTGGGGLLLPLGVRSLRAYGPTRNAQYCYTRVTKADANGGEADLELLDEQGCVLLAVRGLRLGTGTSESGERDRVLSERLLTLEWQQRQLPEVLDEETGSWLLISASDGEDLMATTLADALKSQGAECASMVWSAQDDLAGGIEKLGAQLRARTNKGVVIVCGPRSGDADEQSLLQGREQVRHLVRITRGLAELEGELPRLFVVTRQAQRVRPEDEINLEQAGLRGLLRVIGSEHPLLQTTQVDVDESTQAEQLAQQLLGGSEEDETAWRGGEWYVARLFPGPLSADERQTTVVDHERDNMRLQIRTPGDLQTLELAACDRVPPGPGQIEVAVTMSSINFADVLIAFGRYPSLEGRLPETGTDFVGVVTAVGEGVTDHQVGDRVGGFSKDGCWRSYLTCDANLAVTLPAGLSDEHAAASSTAHATAWYGLNDLAGIKAGDRVLIHSATGGVGQAAIAIARAAGAQIFATAGNAERRQLVNDMGIEHVYDSRSIEFADQIRRDTNGYGVDIVLNSLTGAAQRAGLELLAFGGRFVEIGKADVYGNTRMGLYPFRRGLTFYYVDLGLMSVIQPERVRELLSTVYNLTAEGVLSAPECTHYPLAEAAEAIRTMSNAAHTGKLLLDMPRSGRRGVVVPPEQVEVFRGDGSYIITGGLGGLGLFFASKMAAAGCGRIVLTARSQPNPKSRQAIERLRANGADIVVECGNIAEPETADRLVSAATATGLPLRGVLHAAAVVEDATLSNITDELIDRDWSPKVYGSWNLHRASTGQPLDWFCLFSSGAALMGSPGQGAYAAANSWVDAFAHWRRAQGLPVCAIGWGAWGEVGRATFLAEGGEIMIAPDEGMYAFEQMLRHARTYTGYIPIIGAPWLADLVRRSPWAEMFQSSGQNTRGPSKFLAELKLLPQEEWAGRLRRLIAEQASVILRRTVDADRPFVEYGLDSLGMLEMRTHIETETGVRLSPKVIASHNTARALSQHLADTLAEEEAQPAAS

SEQ ID NO: 14 - protein, 2099 aa, Mycobacterium liflandii
MQKPATPVAIIGMGCRLPGGVDSPEKLWESLLRGDDLVSEIPPDRWDVDDYYDPEPGVPGRTVSRWGGFIDDVAGFDAEFFGVSEREATSIDPQHRQLLETAWEAIEHAGLDPASLSGSSTGVFVGLSHEDYLVRSVLAGDLAGPYASTGLINSVASGRIAHTLGLHGPAMTVDTACSSGLLTVRLACLSLHEGESDLALAGGCALLLEPNGSVSLSSQGMLSPTGRCHAFDVDADGFVRSEGCAVVVLKRLSDALADGDRILAVVRGTAANQDGRSETLLMPSETAQVAVYREALAAAGVDAASVGAVEVHGTGTPVGDPIEYRSLAQVYGSGGSRCMLGSVKTNIGHSESAAGTVGLIKATLSLGHGVVPPMVHHTRLPDELAEIETGLYVPHEITPWPEDQGPRRMAVSSFGMSGTNVHAILEEPPTPAPARDQAPAEPGMASPLLFALSSTSADGLRQTARELAEWVGSRADSADSTEAVDLAYTLARRRAHRPVRTAVVAASLPELVEGLQEVAEGDLMYEAAVGRGDRGPVWVFSGQGSQWAAMGADLLANEPVFAATVAAVEPIIAHESGFSVTEAMTAPEKVTGIDKVQPTLFAMQVALAATMEKTYGVRPGAVIGHSLGEAAAAVVAGSLSLEDGARVISRRSKLMLRISGAGAMASVELPAKQVNSELMARGIDDVAVAVVASPQSTVVGGATDTVRDLVARWEQREVMAREVAVDVASHSPQVDPILEDLATALADIVPSDPKVPYYSATLFDPRERPTCDAAYWVDNLRNTVQFAAAVQAALEDGFRVFAELSPHPLLTHAVDQNARSLDMSAAALAGMRREQPLPHGLRGLLTDVHSAGAAVDFSVLYPAGRLVNAPLPAWTHRRFFVDGEGQDSKAQGACSVTVHPLLGAHVRLSEQPERHVWQTDVGTDTLSWLSDHQVRNVAALPGAAYCEMALAAAGEVFGEAFEVRDLAFEQMLLLDEETPIDAVASLDSPGAANFVVQTHVDGETTRHATAALRASDDESVPPAYDIAALLAAHPVSVNGAELREAFVERGIQHGPAFSGLAIARTAETEGGTVLAEVALPASIRFQQGAYGVHPALLDACFQSVAAGVKSTGGGGLLLPLGVRSLRAYGPTRNAQYCYTRVTKADANGGEADLELLDEQGCVLLAVRGLRLGTGTSESGERDRVLSERLLTLEWQQRQLPEVLDEETGSWLLISASDGEDLMATMLADALKSQGAECASMVWSAQDDLAGGIEKLGAQLRARTNKGVVIVCGPRSGDADEQSLLQGREQVRHLVRITRELAELEGELPRLFVVTRQAQRVRPEDEINLEQAGLRGLLRVIGSEHPLLQTTQVDVDESTQSEQLAQQLLGGSEEDETAWRGGEWYVARLFPGPLSADERQTTTVDHERDNMRLQIRTPGDLQTLELAACDRVPPGPGQIEVAVTMSSINFADVLIAFGRYPSLEGRLPETGTDFVGVVTAVGEGVTDHQVGDRVGGFSKDGCWRSYLTCDANLAVTLPAGLSDEHAAASSTAHATAWYGLNDLAGIKAGDRVLIHSATGGVGQAAIAIARAAGAQIFATAGNAERRQLLNDMGIEHVYDSRSIEFADQIRRDTNGYGVDIVLNSLTGAAQRAGLELLAFGGRFVEIGKADVYGNTRMGLYPFRRGLTFYYVDLGLMSVIQPERVRELLSTVYNLTAEGVLSAPECTHYPLAEAAEAIRTMSNAAHTGKLLLDMPRSGRRGVVVPPEQVEVFRGDGSYIITGGLGGLGLFFASKMAAAGCGRIVLTARSQPNPKSRQAIERLRANGADIVVECGNIAEPETADRLVSAATATGLPLRGVLHAAAVVEDATLSNITDELIDRDWSPKVYGSWNLHRASTGQPLDWFCLFSSGAALMGSPGQGAYAAANSWVDAFAHWRRAQGLPVCAIGWGAWGEVGRATFLAEGGEIMIAPDEGMYAFEQMLRHARTYTGYIPIIGAPWLADLVSRSPWAEMFQSSGQNTRGPSKFLAELKLLPQEEWAGRLRRLIAEQASVILRRTVDADRPFVEYGLDSLGMLEMRTHIETETGVRLSPKVIASHNTARALSQHLADTLAEEEAQPAAS

SEQ ID NO: 15 - protein, 2126 aa, Mycobacterium tuberculosis
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 16 - protein, 2126 aa, Mycobacterium tuberculosis
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSVLGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 17 - protein, 2126 aa, Mycobacterium tuberculosis
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPGLAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 18 - protein, 2126 aa, Mycobacterium tuberculosis
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPGSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 19 - protein, 2126 aa, Mycobacterium bovis
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAGDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 20 - protein, 2126 aa, Mycobacterium tuberculosis
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFGGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPEAVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 21 - protein, 2126 aa, Mycobacterium canettii
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQSAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRLVLNSRTQPTQKVRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 22 - protein, 2126 aa, Mycobacterium canettii
MGLGSAASGTGADRGAWTLAEPRVAPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNEPVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGVDDVVVAVVTAPQSTVIAGGTESVRKLVDIWERRDVLARAVAVDVASHSPQVDPILDELMAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAAHPLLGAHVRLPEEPERHAWQADVGTATLPWLGDHRIHNVAALPGAAYCEMALSAARAVFGEQSEVRDMRFEAMLLLDDQTPVSTVATVTSPGVVDFAVEALQEGVGHHLRRASAVLQQVSDECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELAGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGPNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSTEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRLVLNSRTQPTQKVRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 23 - protein, 2126 aa, Mycobacterium canettii
MGLGSAASGTGADRGAWTLAEPRVTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGVDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLADLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSDECEPPAYDMASLLEAHPCRVDGEDLRRRFDKHGVQYGPAFTGLAVAYVAEDATATMLAEVALPGSIRSQQGLYAIHPALLDACFQSVGAHPDSQSVGSGLLVPLGVRRVRAYASVRTARYCYTRVTKVELAGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGPNTGTPHQGSADRGAEYVRRLVGIARELSDLPGAVPRMYVVTRGAQRVLADDCVNLEQGGLRGLLRTIGAEHPHLRATQIDVDEQTGVEHLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSTEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPLPQSTHYPLVEAATAIRVMGNAEHTGKLVLHIPQNGKSLVTLPPEQAQVFRPDGSYIITGGLGGLGLFLAEKMAAAGCGRLVLNSRTQPTQKVRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVSEQVSLILRRTVDPDRPLPEYGLDSLGALELRTRIETETGIRLAPKNVSATVRGLADHLYEQLAPDDAPAAALSSQ

SEQ ID NO: 24 - protein, 2103 aa, Mycobacterium tuberculosis
MTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDGPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 25 - protein, 2103 aa, Mycobacterium tuberculosis
MTPVAVIGMACRLPGGIDSPELLWKALLRGDDLITEVPPDRWDCDEFYDPQPGVPGRTVCKWGGFLDNPADFDCEFFGIGEREAIAIDPQQRLLLETSWEAMEHAGLTQQTLAGSATGVFAGVTHGDYTMVAADAKQLEEPYGYLGNSFSMASGRVAYAMRLHGPAITVDTACSSGLTAVHMACRSLHEGESDVALAGGVALMLEPRKAAAGSALGMLSPTGRCRAFDVAADGFVSGEGCAVVVLKRLPDALADGDRILAVIRGTSANQDGHTVNIATPSQPAQVAAYRAALAAGGVDAATVGMVEAHGPGTPIGDPIEYASVSEVYGVDSPCALASVKTNFGHTQSTAGVLGLIKVVLALKHGVVPRNLHFTRLPDEIAGITTNLFVPEVTTPWPTNGRQVPRRAAVSSYGFSGTNVHAVVEQAPQTEAQPHAASTPPTGTPALFTLSASSADALRQTAQRLTDWIQQHADSLVLSDLAYTLARRRTHRSVRTAVIASSVDELIAGLGEVADGDTVYQPAVGQDDRGPVWLFSGQGSQWAAMGADLLTNESVFAATVAELEPLIAAESGFSVTEAMTAPETVTGIDRVQPTIFAMQVALAATMAAYGVRPGAVIGHSMGESAAAVVAGVLSAEDGVRVICRRSKLMATIAGSAAMASVELPALAVQSELTALGIDDVVVAVVTAPQSTVIAGGTESVRKLVDIWERRDVLARAVAVDVASHSPQVDPILDELIAALADLNPKAPEIPYYSATLFDPREAPACDARYWADNLRHTVRFSAAVRSALDDGYRVFAELSPHPLLTHAVDQIAGSVGMPVAALAGMRREQPLPLGLRRLLTDLHNAGAAVDFSVLCPQGRLVDAPLPAWSHRFLFYDREGVDNRSPGGSTVAVHPLLGAHVRLPEEPERHAWQADVGTATLPWLGDHRIHNVAALPGAAYCEMALSAARAVLGEQSEVRDMRFEAMLLLDDQTPVSTVATVTSPGVVDFAVEALQEGVGHHLRRASAVLQQVSGECEPPAYDMASLLEAHPCRVDGEDLRRQFDKHGVQYGPAFTGLAVAYVAEDATATMLAEVALPGSIRSQQGLYAIHPALLDACFQSVGAHPDSQSVGSGLLVPLGVRRVRAYAPVRTARYCYTRVTKVELVGVEADIDVLDAHGTVLLAVCGLRIGTGVSERDKHNRVLNERLLTIEWHQRELPEMDPSGAGKWLLISDCAASDVTATRLADAFREHSAACTTMRWPLHDDQLAAADQLRDQVGSDEFSGVVVLTGSNTGTPHQGSADRGAEYVRRLVGIARELSDLPGAVPRMYVVTRGAQRVLADDCVNLEQGGLRGLLRTIGAEHPHLRATQIDVDEQTGVEQLARQLLATSEEDETAWRDNEWYVARLCPTPLRPQERRTIVADHQQSGMRLQIRTPGDMQTIELAAFHRVPPGPGQIEVAVRASSVNFADVLIAFGRYPSFEGHLPQLGTDFAGVVTAVGPGVTDHKVGDHVGGMSPNGCWGTFVTCDARLAATLPPGLGDAQAAAVTTAHATAWYGLHELARIRAGDTVLIHSGTGGVGQAAIAIARAAGAEIFATAGTPQRRELLRNMGIEHVYDSRSIEFAEQIRRDTNGRGVDVVLNSVTGAAQLAGLKLLAFRGRFVEIGKRDIYGDTKLGLFPFRRNLSFYAVDLGLLSATHPEELRDLLGTVYRLTAAGELPMPQSTHYPLVEAATAIRVMGNAEHTGKLVLHIPQTGKSLVTLPPEQAQVFRPDGSYIITGGLGGLGLFLAEKMAAAGCGRIVLNSRTQPTQKMRETIEAIAAMGSEVVVECGDIAQPGTAERLVATAVATGLPVRGVLHAAAVVEDATLANITDELLARDWAPKVHGAWELHEATSGQPLDWFCLFSSAAALTGSPGQSAYSAANSWLDAFAHWRQAQGLPATAIAWGAWSDIGQLGWWSASPARASALEESNYTAITPDEGAYAFEALLRHNRVYTGYAPVIGAPWLVAFAERSRFFEVFSSSNGSGTSKFRVELNELPRDEWPARLRQLVAEQVSLILRRTVDPDRPLPEYGLDSLGALELRTRIETETGIRLAPKNVSATVRGLADHLYEQLAPDDAPAAALSSQ

SEQ ID NO: 26 - protein, 2070 aa, Mycobacterium tuberculosis
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGMTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAEVDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGDVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 27 - protein, 2085 aa, Mycobacterium bovis
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAEVDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGAVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 28 - protein, 2085 aa, Mycobacterium canettii
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAELDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGDVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIALELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPPTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 29 - protein, 2085 aa, Mycobacterium canettii
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAELDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGDVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTSGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 30 - protein, 2085 aa, Mycobacterium bovis
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAEVDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGAVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVPPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 31 - protein, 2085 aa, Mycobacterium tuberculosis
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALVAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAEVDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAAVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGDVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 32 - protein, 2085 aa, Mycobacterium bovis; identical to SEQ ID NO: 27

SEQ ID NO: 33 - protein, 2085 aa, Mycobacterium canettii; identical to SEQ ID NO: 29

SEQ ID NO: 34 - protein, 2085 aa, Mycobacterium bovis; identical to SEQ ID NO: 30

SEQ ID NO: 35 - protein, 2086 aa, Mycobacterium canettii
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLMAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAELDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPEGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALKEMPQPPGYDTNALTAAHESSMSGEELRKMFNSLGIQYGPAFSGLVAVHTARGDVTTVLAEVALPGAIRSQQSAYASHPALLDACFQSVLVHPEVQKATVGGLMLPVGVRRLRNYHSTRGAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNGETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRMSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 36 - protein, 1582 aa, Mycobacterium africanum
MTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAEVDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGDVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGFGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 37 - protein, 2108 aa, Mycobacterium tuberculosis
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGEPPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 38 - protein, 2108 aa, Mycobacterium tuberculosis
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGEPPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSQSSQELRARVEAETGIRISATEINTTVRGLADLMCDKLAADRDAPAPA

SEQ ID NO: 39 - protein, 2108 aa, Mycobacterium tuberculosis
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGEPPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAARVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 40 - protein, 2108 aa, Mycobacterium tuberculosis
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGETPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 41 - protein, 2108 aa, Mycobacterium tuberculosis
MGKERTKTVDRTRVTPVAVMGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGEPPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDAADLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 42 - protein, 2108 aa, Mycobacterium bovis
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGETPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAALDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 43 - protein, 2108 aa, Mycobacterium tuberculosis
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGETPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARNARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 44 - protein, 2112 aa, Mycobacterium canettii
MAGLPWLGEVATMHSTGVTPVAVIGMGCRLPGGIDSPDRLWEALLRGDDLVTEVPADRWDADEYYDPEPGVPGRSVCRWGSFLDNVGDFDPEFFGISEREATAMDPQHRLLLETAWEAMEHGGLTPNQMASRTGVFVGLMHDDYQFVHADAQTLAGPYGYIGNSFAMGSGRIAYAMGLQGPAITVDTACSSGLTAIHLACRSLHDGESDIALAGGASVMLEPRKAASGSALGMLSATGRCHAFDVSADGFVSGEGCVMLALKRLPDALADGDRILAVIRGTAANQDGHTVNIVTPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGETPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLTDMMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCYATVTACGVGVEADLDVLDEHGAVVLAVRGLQLGTGASQASERARVLGERLLGIEWHERELPENSHAEPGAWLLISTSAAADLLATELTDALKLREAQCTTMSWPQRADHAAQAARLRDQLGTGGFTGVFVLTAPQTGDPAAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSNVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 45 - protein, 2090 aa, Mycobacterium marinum
MTPVAVIGMACRLPGGIGSPEELWEALLRGDDLVTEIPADRWDADEYYDPEPGVPGRTVCKWGAFLDNVGDFDPEFFGITEKEAIAIDPQHRMLLETAWEAMEHGGLTPEQMAESLTGVFVGLNHGDYQFVHVDANTFDGPYGNTGTNSCFASGRISYAMRLHGPAVTVDTACSSSLYATHLACNSLSEGESDLAFAAGVYVMLEPRRFASGSAQNMLSPTGHCHAFDVDADGFVSGEGSVVLLLKRLADAQRDGDRILAVMRGTAANQDGHTVNIATPSVEAQSAVYRAALATAGVDGASVGLVEAHGTGTPVGDPIEFESLARVYGIDRPCALTSAKPNFGHMQAGAGVLGLMKAILALQHGVIPPNIHFSRLPDEMAQIKSGLFVPQEITQWPTNGEQTRTAAVSSYGISGTNVHAILEQAPETATHDAEPVSPAIEGALIFPLSATSADGLRQTAKRLADWVDAQGPELATSDLAYTLARRRGHRPVRTAVLADNVSELSAGLHEIADDETPYQAAVGRDDRGPVWVFSGQGSQWKAMGADLLANEPVFAATVAELEPLIAAESGFSVTEAMTAIETVTGIDRVQPTIFTMQVALAATMKSYGVRPGAIIGHSLGESAAAVAAGALSLEDGAKVICRRSRLMTRISGSGAMASVELPAQQVLSELMARGINDVVVAVVASPQSTVIGGATDTVRELVAAWEQREVMAREVAVDVASHSPQVDPILDDLYDVLADLEPLTPEVPYYSATLFDPREEPYCDGSYWVDNLRHTVRFGAAVQAALEDGYRVFAELAPHPLLTRAVEKTAEGLDMPVAALAGMRREQPLPHGLRGLLADLHSAGAAVDFSVLYPAGELVDAPLPAWTHQSLLLNRAGQDHQAQGGSSVVVHPLLGSHVLLPEEPERHVWQSDVGTEALPWLADHQIHSAPALPGAAYCEMALVAARTILGDAAEVRDVRFEQMLLLDDETPLSAVGSVKSPGIVDFVVETFQDGGAVRRGGAVLHAVEDDDQLPAYDIPALLAEHSRTEDGEELRARFDEHGVQYGPAFTGLGNAHIADGAVSSVVAEVALPGAMRSQQRAYAIHPALLDACFQAVGAHPDVQVAGNGGLMLPLGVRQIRAYASTRNAHYCYARVTSVDTSAVEADLDVLDEHGTVLVAVRGLQLGTGVSEEGNRDRVLNERLLTIEWQQRELPEVDAAEAGAWLLISTSDGADMLAAELTDALKLHSAQCATTSWHENAADHAASAERLRNQLNAGGFHNAVILLKPDSGDRDENSGVEGVECVRHVVRVVRELPEIMGEAPRLFVVTRGAQTVLGGESANLEQAGLRGLLRVIGAEYPHLHTTHVDVDEHSGSEVVARQLLSGSEEDETAWRCGQWYTARLSPMPLRPEERKTTVVEHDTEGMRLQIRTPGDLQTMEFVAFDRVAPGPGQIEVAVSTSSINFADVLVSFGRYNSPDGQMPQLGTDFAGVVTAVGPDVTDHQVGDRVGGMSPHGCWATFVTCDGALATPIPAGLTDAQAAAVTTAHATAWYGLHDLGRIRAGDKVLIHSGTGGVGQAAIAIARAAGAEIYATAGSPKRRQVLRDMGIEHVYDSRSIEFAEAIRADTDGYGVDIVLNSLTGAAQRAGLELLAWGGRFVEIGKRDIYGDTKMGLFPFRRNLSFYGVDLGMLSITHPRLIRELLTTVYQHTAEGVLPMPQDTHYPLAEAATAIRVMGAADHTGKLLLDIPRSGRSAVVLPPEQVPVLRADGSYIITGGLGGLGLFLAEKMATAGAGRIVLSSRSAPSQKALETIELIRSIGSDVVVECGDIAQPATAARLVANATATNLPLRGVLHAAAVVEDATLANITDELLDRDWAPKVYGAWHLHQATTDQPLDWFCSFSSAAAMLGSPGQGAYAAANSWLDAFTHWRHNQNQPATAIAWGPWAEIGRAIALAESSDAAIAPDEGAYAFQTLLRHNRTYTGYAPIIGAPWVTAFAERSKFAEAFKALEQGRSGSSKFRSELDALPLDEWPGQLRRMVAEQVSLILRRTIDPDRQLSEYGLDSLGNLELRTRVQSETGIRISSTDITTVRGLADHLFAQLAPEEAAASSQ

SEQ ID NO: 46 - protein, 2141 aa, Mycobacterium colombiense
MTTHQIDDVMQRCPSTDSPPIGATPVTPVAVIGMACRLPGAIDSPEQLWEALLRGDDLVTEIPPDRWDADEYYDPEPGVPGRSVSRWGAFIDDVAGFDPEFFGINDREATAMDPQHRLLLETSWEAMEHAGLTRERIADSRTGVFLGLTHGDYQLLAADTRSVEGAYGFSGSSFSLASGRIAYALGVHGPALTVDTACSSGLTAIHLACRSLHEGESDLALAGGATLALDPRKFSAGSAEGMLSPTGRCHAFDVAADGFVGGEGSVMLLLKRLADALRDGDRILAVVRGTAANQDGHTVNIATPSKTAQTAVYQAALTAAGVDARTVGMVEAHGPGTPVGDPIEYASLANVYGIDGPCALASVKTNFGHAQAASGALGMMKAILALQHGVVPRNLHFSRLPDDLAQIDTNLFVPQETTPWVSNGRHPRRAAVSSYGLSGTNVHAIVEQAPERAAEAVAPEVVSAELSVTAPLFAGDDPLCTASPGLRSPLLFPLSSTSADELRRTAGRLADWVRAHDDLALPDLAYTLARRRAHRPVRTAVIGGNRLELAEALREVADGDTPYPAAVGQDDRGPVWVFSGQGSQWAAMGADLLAVEPVFAATVAQAESVIAQESGFSVTEAISAPQVVTGQDRIQPTLFTMQVALAATMRSYGVRPGAVIGHSLGEAAAAVVAGALSLEDGLRVICRRSRLMFRVAGTGATASVELPAQQVLSELTARGINDVVVAVVASPQSTVIAGAAQTVRDLVAAWERREVMAREVPTDVAFHSPQVDPIMDELTEALAEISPTTPEVPFYSATLFDPREQPVCDARYWANNMRRMVRFATAVQAALEDGYRVFAELAPHPLLIRALEQTARSREMPMAALAGMRREQALPHGLRGFVADLHSAGAAVDFAKLYPSGRLVDAPLPTWTHRRLWLSGGGQESPTHGGCTVSVHPLLGSHVHLQEEPERHLWQAEVGTAAQPWLADHQIRNVAVLPGAAYCEMALAAARTVLGETAEIQDIRFEQALLLDEQTTIGASASLSSPGVVDFTVESNQGGEQVRHAAAVLRAAEDERPPAYNVSALLAAHASCDDGAEVRKRMDRRGVQYGPAFAGLGRVHTGEEATGTVLSEVALPRQIRSQQAAYGVHPALLDACFQSVEAHPDVQALGEGALGLVLGIRRLRSYGAARNAHYCYTRVTKADTSGVEADIDVLDEHGAVLLTVQGLRVGASASESGTRDRVLAERLLTVEWRQRELPEPDHTDAGSWLLIGTATTADVVASTLADALKNQGVHCTTMSWPQHADHASNVGQLGSHLRGGGFTGVVILTGPKNGDTDDQCALLGRDYVQHLVRIARELTDLPGEPPRLYVVTRNAQSVVSNDVPNLGQAGLRGLVRVIGMEHPHLGVSQIDLDESTDVEQLARQLLAGSEEDETAWRNGAWYNARLCPAPLLPEERRTAVVNHEYDGMRLQIRTPGDLESLELVACERVPPGPGEIEVAVSASSINFADVLVAFGRYPAFEGRLPQLGTDFAGVVTAVGPDVTGHKVGDRVGGLSANGCWGTFLTCDARLAVTLPAGLAEDQAAAVTTAHATAYYGLHELARIGSGDRVLIHSATGGVGQAAIAIARAAGAEIFATAGSEQRRQLLRDMGIEHVYDSRSVEFADLIRRDTDGYGVDIVLNSVVGAAQRAGVELLAFGGRFVEIGKRDIYGDTRLGLLPFRRNLTFYALDLALMSFSHPDRLRGLLDTVYRLTADGSLPMPQSTRHPLADAATAIRVMSGAQHTGKLVLDVPHTGRSRVVVPPAQVGVFRGDGAYIITGGLGGLGLFLAEKMASAGSGAGCRRIVLSSRSQPEPGALETIERIREIGADVVVERGDIAEAGTAERLVATATATGLPVRGVLHLAAVIEDATLANITDELIERDWAPKVYGAWNLHRALQGAGAEQTLDWFCSFSSAAALVGSPGQGAYAAANSWLDAFTRWRRARGLPATAIAWGAWAQIGRGTALAAGADVAIAPDEGAYAFEALLRHDRACTGYAPITDTPWLTAFAQRSPFAEAFRSAGQSSTGTSKLRAELDELALDEWPTRLRRLISDQVSLILRRNIDPDRPLSEYGLDSLGGLELLTRIQTETGIRVTPADIATIGTIRGLAELLYGKLAPAEAA

SEQ ID NO: 47 - protein, 2116 aa, Mycobacterium indicus pranii
MTTYPIDDVMQRWPSTDSPPIGATPVTPIAVIGMACRLPGGIDSPEQLWEALLRGDDLVTEIPHDRWDADEYYDPEPGVPGRSVSRWGAFIDDVAGFDPEFFGINEREATAMDPQHRILLETSWEAMEHAGLTRERIADSRTGVFMGLTHGDYQLLAADAHSVEGAYGFSGSNFSLASGRIAYALGVHGPALTVDTACSSGLTAIHLACRSLHERESDLALAGGATLALDPRKFAAGSAEGMLSPTGRCHAFDVAADGFVGGEGSVMLLLKRLSDALRDGDRILAVVRGTAANQDGHTVNIATPSKTAQTAVYQAALAAAGVDARTVAMVEAHGPGTPVGDPIEYASLADVYGVEGPCALASVKTNFGHAQAASGALGMMKAILALQHGVVPRNLHFTRLPDDLAKIDTKLFVPLETTPWTTNGDHPRRAAVSSYGLSGTNVHAIVEQAPEQALKTVVSQAESSTTEPLIFPLSSTSADELRRTAGRLAGWVRAHDDLALPDLAYTLARRRVHRPVRTAVIADSRAGLVVALREVADGDAPYQPAVGQDDRGPVWVFSGQGSQWAAMGADLLATEPVFAATVAEVEPLIARESGFSVIAAMSAPQTVAGQDRVQPTLFAMQVALAATMKAYGVRPGAVIGHSLGEAAAAVVAGAMSLEDGARVICRRSRLMSRIAGAGATASVELPAQQVLSELTARGVNDVVVAVVASPQSTVIAGAAQTVRDLVAAWEQRDVMAREVPTDVAFHSPQVDPIMDELTAMLAEIRPMTPEVPYYSATLFDPREQPVCDARYWANNMRRMVRFATAVQAALEDGFRVFAELAPHPLLTRALEQTARGREMPMAALAGMRRQQSLPHGLRGFVADLHSAGAAVDFSVLYPSGRLVDAPLPTWTHRRLWLSGGGQESPTHGGCTVSVHPLLGSHVHLQEEPERHVWQAEVGTAAQPWLADHQIRNVVVLPGAAYCEMALAAARTVLGETAEVRDIRFEQALLLDEQTTIGALASLSSPGVVEFTVESNRGGEQARHAAAILRAAEDDRPPAYDMCALLAAHTGSDDGDEVRARMDRRGVQYGPAFAGLGVVHTGKEAPGTVLAEVALPRQIRSQQALYGVHPALLDACFQSVEAHPDVRALGDGALGLVLGIRRLRAYGAARNAHYCYTRVTKAETSGVEADIDVLDEHGAVLLTVQGLRVGTSASESGNKDRVLAERLLTVEWRQRELPEPDHTDAGSWLLLGTSATADVAASSLADALKNHGMQCTTMSWPRHADHSSTVGQLGNHLRTGGFAGAVILIGPDNGESDEQCALLGRDYVQHLARIARELVDVPGEPPRLYVVTRNAQTVVSNDVPDLAQAGLRGLVRVIGMEHPHLGASLIDVDETTDAEQLARQLLAGSDEDETAWRNGAWYTARLCPTPLLAEERKTAVANHESDGMRLQIRTPGDLESLELVACDRVPPGPGEIEVAVSASSINFADVLVAFGRYPAFEGRLPALGTDFAGVVTAVGPGVTGHRVGDHVGGLSANGCWATFLTCDARLAVTLPPGLADDQAAAVTTAHATAYYGLHELARIKAGERVLIHSATGGVGQAAIAIARAAKAEIFATAGSEQRRQLLRDMGIEHVYDSRSVEFADLIRRDTDGYGVDIVLNSVVGAAQRAGVALLAFGGRFVEIGKRDIYGDTRLGLFPFRRNLTFYALDLALMSFSHPNRLRDLLNTVYRLTADGSLPMPQSTHYPLADAATAIRVMSGAQHTGKLVLDVPRTGRSRVMVPPAQVGVFRSDGAYIVTGGLGGLGLFLAEKMATPGSGAGCGRIVLSSRSQPTPEALEMIERIRAIGADVVVDCGDITEAETARRLVATATATGLPVRGVLHLAAVIEDATLTNITDELIERDWAPKVYGAWNLHTATASQPLDWFCSFSSAAALVGSPGQGAYAAANSWLDAFTRWRRARGLPATAIAWGAWAQIGRATALADRADAAIAPDEGAYALEALLRHDRACTGYAPITATPWLAAFAQRSPFAEAFRSNGQSATGTSRLRAELEELTLDEWPTRLRRLISDQVSLILRRNIDPDRPLSEYGLDSLGGLELLTRIQTETGIRVMPADIASIGTIRGLAELLCSKLAPADAA

SEQ ID NO: 48 - protein, 2126 aa, Mycobacterium tuberculosis
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEEAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLGGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATGEPIVIPTLGRDDGGVGRFWLSAGQAHVAGVGVDWRAAFADLGGRRVELPTYAFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPADGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWQGVCLHASGAARVRVRLAPVGRGAVSVELADPQGLPVLSVRQLMVRPVSAAALSRSTAGDRGLLEMIWTPVPLEGGDIGDDAVVWELPPHAGAQAGGDVLAAVYRGVHEVLEVLQSWLASDATGLGVVVTRGAVGPVDDDVTDLAGAAVWGLVRSAQAEHPGRVVLVDTDGSVAVEDAVGFGARSGEPQLVVRRGRVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLEFEEAFLRATEGSGVDVVLNSLAGEFTDASLRLLPSGGRFIELGKTDIRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALQADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSANVKAHLRTRLQTMLTSLTTEDDDIAAATESQLFAILDEELGS

SEQ ID NO: 49 - protein, 2126 aa, Mycobacterium tuberculosis
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEEAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLGGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATGEPIVIPTLGSDDGGVGRFWLSAGQAHVAGVGVDWRAAFADLGGRRVELPTYAFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPADGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWQGVCLHASGAARVRVRLAPVGRGAVSVELADPQGLPVLSVRQLMVRPVSAAALSRSTAGDRGLLEMIWTPVPLEGGDIGDDAVVWELPPHAGAQAGGDVLAAVYRGVHEVLEVLQSWLASDATGLGVVVTRGAVGPVDDDVTDLAGAAVWGLVRSAQAEHPGRVVLVDTDGSVAVEDAVGFGARSGEPQLVVRRGRVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLEFEEAFLRATEGSGVDVVLNSLAGEFTDASLRLLPSGGRFIELGKTDIRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALQADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSANVKAHLRTRLQTMLTSLTTEDDDIAAATESQLFAILDEELGS

SEQ ID NO: 50 - protein, 2126 aa, Mycobacterium tuberculosis
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEEAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLGGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFARAVRNAFDGGYRVFVESSPHPVLIAGIEETLVDCDRGATGEPIVIPTLGRDDGGVGRFWLSAGQAHVAGVGVDWRAAFADLGGRRVELPTYAFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPADGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWQGVCLHASGAARVRVRLAPVGRGAVSVELADPQGLPVLSVRQLMVRPVSAAALSRSTAGDRGLLEMIWTPVPLEGGDIGDDAVVWELPPHAGAQAGGDVLAAVYRGVHEVLEVLQSWLASDATGLGVVVTRGAVGPVDDDVTDLAGAAVWGLVRSAQAEHPGRVVLVDTDGSVAVEDAVGFGARSGEPQLVVRRGRVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLEFEEAFLRATEGSGVDVVLNSLAGEFTDASLRLLPSGGRFIELGKTDIRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALQADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSANVKAHLRTRLQTMLTSLTTEDDDIAAATESQLFAILDEELGS

SEQ ID NO: 51 - protein, 2126 aa, Mycobacterium tuberculosis
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEEAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLGGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATGEPIVIPTLGRDDGGVGRFWLSAGQAHVAGVGVDWRAAFADLGGRRVELPTYAFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPADGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWQGVCLHASGAARVRVRLAPVGRGAVSVELADPQGLPVLSVRQLMVRPVSAAALSRSTAGDRGLLEMIWTPVPLEGGDIGDDAVVWELPPHAGAQAGGDVLAAVYRGVHEVLEVLQSWLASDATGLGVVVTRGAVGPVDDDVTDLAGAAVWGLVRSAQAEHPGRVVLVDTDGSVAVEDAVGFGARSGEPQLVVRRGRVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLEFEEAFLRATEGSGVDVVLNSLAGEFTDASLRLLPSGGRFIELGKTDIRDGQTVAERHRGVRYRAFDLVEAGPDRIAAMLSEVVGLLAAGVLARLPVKTFDARCAPAAYRFVSLARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALQADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSANVKAHLRTRLQTMLTSLTTEDDDIAAATESQLFAILDEELGS

SEQ ID NO: 52 - protein, 2126 aa, Mycobacterium bovis
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEEAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLWDAAAVVALRSRLLVRLGGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATGEPIVIPTLGRDDGGVGRFWLSAGQAHVAGVGVDWRAAFADLGGRRVELPTYAFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPADGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWQGVCLHASGAARVRVRLAPVGRGAVPVELADPQGLPVLSVRQLMVRPVSAAALSRSTAGDRGLLEMIWTPVPLEGGDIGDDAVVWELPPHAGAQAGGDVLAAVYRGVHEVLEVLQSWLASDATGLGVVVTRGAVGPVDDDVTDLAGAAVWGLVRSAQAEHPGRVVLVDTDGSVAVEDAVGFGARSGEPQLVVRRGRVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLEFEEAFLRATEGSGVDVVLNSLAGEFTDASLRLLPSGGRFIELGKTDIRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALQADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSANVKAHLRTRLQTMLTSLTTEDDDIAAATESQLFAILDEELGS

SEQ ID NO: 53 - protein, 2126 aa, Mycobacterium canettii
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEQAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLGGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATGEPIVIPTLGRDDGGVGRFWLSAGQAHVAGVGVDWRAAFADLGGRRVELPTYGFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPAGGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWEGVCLHASGAARVRVRLAPVGRGAVSVELADPQGLPVLSVRQLMVRPVSAAALSRSTAGDRGLLEMIWTPVPLEGGDIGDDAVVWELPPHAGAQAGGDVLAAVYRGVHEVLEVLQSWLASDVTGLGVVVTRGAVGPVDDDVTDLAGAAVWGLVRSAQAEHPGRVVLVDTDGSVAVEDAVGFGARSGEPQLVVRRGRVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLEFEEAFLRATEGSGVDVVLNSLAGEFTDASLRLLPRGGRFIELGKTDIRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALQADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSANVKAHLRTRLQTMLTSLTTEDDDIAAATESQLFAILDEELGS

SEQ ID NO: 54 - protein, 2126 aa, Mycobacterium canettii
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEQAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLAGAGGMVSLACGQPQAEKLASQWGDRLNIAAVNGVSSIVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVECSPHPVLIAGIEETLVDCDRGATGEPIVIPTLGRDDGGVGRFWLSAGQAHVAGVGVDWRAAFADLGGRRVELPTYGFARQRFWLDGLGAAGGDLGGVGLVGAEHGLLAAVVQRPDSGGVVLTGRISVVAAPWLADHAVGPVVLFPGTGFVELALRAGDEVGCSVLQELTLQAPLVLPAGGVRVQVVVGGVEQSGTRNVWVYSAAGQADSSPGWTLHAQGVLGVGSVQPAAELSVWPPVGARAMDVADGYQVLAARGYGYGPAFRGLQTLWLRGAEVFADVTLPEGVPIRGFGIHPAVLDAALHAWGIVEGEQQTMLPFSWQGVCLHASGAARVRVRLAPVGRGAVSVELADPQGLPVLSVRQLMVRPVSAAALSRSTAGDRGLLEMIWTPVPLEGGDIGDDAVVWELPPRAGAQAGGDLLAAVYRGVHEVLEVLQSWLASDATGLGVVVTRGAVGPVDDDVTDLVGAAVWGLVRSAQAEHPGRVVLVDTDGSVAVEDAVGSGARSGEPQLVVRRGGVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGVVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHIADSRSLKFEETFLRATEGSGVDVVLNSLAGEFTDASLRLLPRGGRFIELGKTDLRDGQTVAERHRGVRYRAFDLVEAGPDRIAAMLSEVVGLLAAGVLARLPVKTFDARCAPAAYRFVSQARHIGKVVLTIPEGPGGQSGLAGGTVVVTGGTGMAGSAVATHLVRQHGVANLVLVSRSGEQADRAAEVAALLREGGAQVAVVSCDVADRDALAALLAGLDPRYPLKGVFHAAGVLDDAVIMGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALLADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSADVKAHLRTRLQTVLTSLTTEDDDIAAATESQLFAILDEELGS

SEQ ID NO: 55 - protein, 2126 aa, Mycobacterium canettii
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRDSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEQAPAVEPVGAAHGNDPVAVPWVLSARSAQALTNQARRLLAWVGADENVRPPDVGWSLVNTRPLFDHRAVVVGADRTQLMEGLKGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLAGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATDEPIVIPTLGRDDGGVGRFWLSAGQAHVAGVGVDWRAAFADLGGRRVELPTYGFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPSGGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWQGVCLHASGAARVRVRLAPVGRGAVSVEVADPQGLPVLSVRQLMVRPVSAAALSRSTAGDRGLLELIWTPVPLEGGDIGDDAVVWELPPRAGAQAGGDVLAAVYWGVHEVLEVLQSWLAGDATGLGVVVTRGAVGPVDDDVTDLAGAAVWGLVRSAQAEHPGRVVLVDTDGSVAVEDAVGSGARSGEPQLVVRRGGVYAARLAPLAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTIVPAGWSLVEAAAVPVAFLTAFYGLSVLAEVAAGQKVLVHAGTGGVGMAAVSLARYWGAEVFVTASRAKWDTLRAMGFDDIHISDSRSLEFEEEFLRATEGSGVDVVLNSLAGEFTDASLRLLPRGGRFIELGKTDIRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEIAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALLADRAVVVAARLDRAALAGAGAALPALFSQLAAGPTRRRIDAADPAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTANGSDQQSLSDRVDDITRELVVLLDQPDLSADVKAHLRTRLQTMLTSLTTEDDDIAAATESQLFAILDEELGS

SEQ ID NO: 56 - protein, 2126 aa, Mycobacterium canettii
MNSTPEDLVKALRRSLKQNERLKRENRDLLARTTEPVAVVGMGCRYPGGVDSPETLWELVAHGRDAVSEFPADRGWDVAGLFDPDPDAVGKSYTWCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRWGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEQAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLRDAAAVVALRSRLLVRLAGAGGMVSLACGQTQAEKLASQWGDRLNIAAVNGVSSIVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATGEPIVIPTLGRDDGGVGRFWLSAGQAHVAGVGVDWRAAFADLGGRRVELPTYGFARQRFWLDGLGAAGGDLGGVGLVGAEHGLLAAVVQRPDSGGVVLTGRISVVAAPWLADHAVGPVVLFPGTGFVELALRAGDEVGCSVLQELTLQAPLVLPAGGVRVQVVVGGVEQSGTRNVWVYSAAGQADSSPGWTLHAQGVLGVGSVQPAAELLVWPPVGAQAMDVADGYQVLAARGYGYGPAFRGLQTLWLRGAEVFADVTLPEGVPIRGFGIHPAVLDAALHAWGIVEGEQQTMLPFSWQGVCLHASGASRVRVRLAPVGRGAVSVELADPQGLPVLSVRQLMVRPVCAAALSRSTAGDRGLLEMIWTPVPLEGGDIGDDAVVWELPPRAGAQAGGDLLAAVYRGVHEVLEVLQSWLASDATGLGVVVTRGAVGPVDDDVTDLVGAAVWGLVRSAQAEHPGRVVLVDTDGSVAVEDAVGSGARSGEPQLVVRRGGVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGVVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLKFEETFLRATEGSGVDVVLNSLAGEFTDASLRLLPRGGRFIELGKTDLRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALLADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSADVKAHLRTRLQTMLTSLTTEDDDIAAATESQLFAILDEELGS

SEQ ID NO: 57 - protein, 2120 aa, Mycobacterium marinum
MDSTPDELITALRKTLKENERLKRENRDHLAQATEPVAVVGMGCRYPGGIETPEGLWEMVAAGRDVVSDFPTDRGWDGASLFDPDPDAVGKSYTRSGGFLTDVAGFDAEFFGIAPSEVMAMDPQQRLLLEVSWEALERTGIDPTTLRGSATGVFVGVFHGSYGGQGRVPGDLERYGLRGSTLSVASGRVAYVLGLEGPAVSVDTACSSSLVALHLAVQSLRSRECDLALVGGVTVMATPAMFIEFSRQRALSADGRCKAYAGAADGTAFSEGAGALVLERLTDAQRLGHPVLAVVRGSAVNQDGASNGLATPNGPSQQRVIRAALASARLGVADVDVVEGHGTGTTLGDPIEAQAILATYGQDRTGPGKEPLWLGSIKSNMGHTSAAAGVAGVIKMTLAMQHGVLPQTLHVDVPTPHVDWSAGSVSLLTEARPWPETGRARRAGISSFGISGTNAHVILEQAPAAEEVAAQHRTDLTPWILAARSAPALVNQARRLAQWVSDRPDLDVADVGWSLATTRSVFEHRAVVVGADRTQLIQGLAGFVDGEPRAGVVVGRARPVGKTVFVFPGQGSQWVGMGVDLLDTSTVFADQMHRCEKALAEYVSWSLLDVVRAVPGAPGLNRVDVVQPVLWAIMVSLAELWRSAGVLPDAVIGHSQGEIAAAYVAGALSLEDAARVVARRSQLLVQLSGAGGMVSLACGLERARQLVASWSDRLSIAAVNGVSAIVVSGEVDALDALIGRCEADDIRARRIDVDYASHSAQVEAIRAELAEALDGIAPQSTSTAFISTVTGEFTDTAGLDADYWHRSIRQTVQFERAIRTAFNSGCQVFIESSPHPVLMAGIEETLAGQQDSGEAIVIPSLGRDDGGLQRFWLSVAQAHVAGVRVDWASIIGAGRRVALPTYGFQHRRFWLGQLDAGRTDVGGLGQAGAAHGLLGAVVERPDSGGVVLTGQLSVALQPWLAGHAVAGTVLFPGAGFVELAIRAGDEVGCAAVEELTLSAPLVLPTVGGVQLQVVVGPADQSDHRTVEVYSRGDQSLSEWSLHAEGVLAPAAVASVGQLTAWPPEGATALDLGGVYDRLAARGYEYGPAFRGLQAVWESGDEIFAEVALPEDAGAQIGGFGIHPALLDAALHALVLTAEQNQTVLPFAWQGVSLHAAGASRCRVRIAQSRSGSVAMELADSAGLPVLTVRDLAFRPVSDQTSSAGTAGGGGLLEVVWSPLARPGDDTADIPVTLWDLASQVELSAGAVESTYVATHGALGALQSWLASDQPGVLAVVTHGAVGLADEDVTDLAGSAVWGLVRSAQAEHPGRVVLVDTDGSVELGAVLNSGEPQLVVRAGVAYQARLKPAESLLRLPPPGENWRLVTGGGGTLDDVKVGGCAPSGLMTGQLRVAVAAVGVNFRDVLVALGMYPGGGELGVEGAGIVTEVGPGVSGVAVGDAVMGLLGVVGPEAVVDHRLVTAVPPGWSLQTAASVPVVFLTAFYGLRVLAEVRSGQKLLVHAATGGVGMAAVQLARLWGLEVFATASPGKWDTLRAMGFDDDHIANSRTLEFEEKFRAGTGGVGVDAVLNSLAGEFVDASLRLLVPGGRFIEMGKTDLRDPQTMAEQHRGVGYRAFDLIEAGPDLIARMLAELSRLLCAETLTPLPIKTFDVRLARQAYRFVSQARHIGKVVLTLPDETGAVPAGALAGGTVIITGGTGMAGTALARHVVSRHRVANVILVSRSGAQAEGTSELLGQLQDAGAEAAVVACDVSDRDAVAELLAQVPARYPLRGVIHAAGVLDDGLIASLTPQRVDTVLRAKIDGAWNLHELTRGLNLSAFVLFSSMAGIIGTAGQGNYAAANSFLDGLAVHRRALGLPGVSVAWGLWEQASAMTRHLGERDKARMSRVGLATLSTEHALELFDAAVVADRAVVVATRLDANALKSNSAALPPLLGELAARPKRRVISDADAGDNIAAATGLVARLHGLSAEQRQRELVDVVCSNAATVLGRSSTADINAHRAFQELGFDSLTAVELRNRLKTATGLTLSPTLIFDYPSPAALAEHLGIRLATATAQPDLMRRFDDLARELDKLINRPDWTHEDKGKLSGRLHDILADLSADDDITTASESQLFAILDEELGS

SEQ ID NO: 58 - protein, 2018 aa, Mycobacterium avium subsp. paratuberculosis
MPRSSGSHPVRRWRWTPSSGCCSRCPGKRWSGPELTPRTLRGSATGVFAGIFHGSYGGQGRVPGNLERYGLRGSTLSVASGRVAYALGLEGPAVSVDTACSSSLVALHLAAQSLRSGECDLALAGGVTVMATPAMFIEFSRQRALAADGRCKAYAGAADGTGFSEGVGVLVLERLSDARRLGHSVLAVLRGSAVNQDGASNGLATPNGPSQQRVIRAALANARLGAADVDLVEGHGTGTMLGDPIEAQALLATYGQDRPVDEPLWLGSIKSNMGHTSAAAGAGGVIKMVQALRHGVMPKTLHVDEPTPQVDWSAGAVSLLTEARPWPARDRPRRAGVSSFGISGTNAHVIVEQYEPETIAPQGGDVVVPWVLSARSAEALTNQAARLLARVKADPGVRVLDVGWSLVSTRSRFEHRAVIVGADGAQLLRRLADLAGGQPGAGVVTGRAQPVGKTVFVFPGQGSQWPGMGAQLLDRSTVFAEHMHRCAGALAEHVDWSLIDVIRGTPGAPGLDRVDVVQPALWAVMVSLAELWRSVGVVPDAVIGHSQGEIAAACVAGALSLQDAARVVALRSRLLVRLSGRGGMVSLACGRSRAEQLIAPWGERLNIATVNGISAVVVSGEVDALTELLDRCAADDIRARRIDVDYASHSVQVEEIRDSLAEALRGIAPRSSAVAFFSTVTGELMDTAALDGDYWFRSIRQTVQFERAVRGAAEAGYRAFIECSPHPVLTAAIEETMPDGGQGCVIPSLGRDDGGPDRFWLSAGQAFVSGVVVDWCAMLDGLGGRRVDLPTYGFVRQHFWLPGGSTGSSDVAALGLRGAEHGLLGAVLPRPDSGGVVLTGRLSTSAQAWLADHAVGDTVLFPGAGFVELAIRAGDEVGCGVIDELTLSAPLPLPASGGVRLQLVVGAPDEAGRRPLSVYSAAVHQDSEWMLHAEGVLRAGTVTPAGDLSIWPPIGATAVDVTGGYARLAQRGYEYGRAFRGLRAMWQRGDEIFAEVALPDDAAAGDDFGVHPVLLDAALHVLGVAGEKDQTVLPFSWQGVALHASGASRARVRIAPAGAGAVSVELADGAGLPVLSVRSVTMRPVSPGQLSAAMGTAQPSGLLDVIWSPIALGGNDLGDEVTLWEPGEHGGDVVKSVHAAVTETLAVLQSWLDGEGGGVLAVQTHGAVALAGEDVSDLAGAAVWGLVRSAQAEHPGRLVLIDSDGSLDARAVIPCGEPQVVVRQGVAHAARLRPARAGATLGLPSGAWRLDAGGEGTLGDLVVSRCPRTELADGQVRVAVAAVGVNFRDVLVALGMYPGGGRLGAEGAGVVVEVGPAVTGLAVGDPVMGLLGVVGSEAVVDQRLLTAVPPGLSLVAAAGVPVVFLTALYGLSVLAGLRPGERVLVHTATGGVGMAAVQLARHYGAEVFATASRGKWDTLRAMGFDDDHIGDSRSPDFEQKFLAATGGAGVDVVLNSLAGEFTDASLRLLAPGGRFIEMGKTDVRDPDVVAQRYRGARYRAFDLMEAGPDRTAAMLAEIVGLLQEGVLTPLPLKTFDVRCASAAYRYVSQARHIGKVVLTVPSGLGEVLSGCGGGLAQSTVLITGGTGMAGSALARHLVDRYRVGHVVLVSRTGAQAAGAAELVDELQRAGASASVLACDVADRDAVATMLAGLPAGYPLRGIVHAAGILDDGLLSSLIPDRVDAVLRAKVDGAWNLHELTKDLDLSAFVVFSSMAGIVGTPGQANYAAANSFLDGLVAHRRADGLAGLSLAWGLWEQASAMTAHLGDRDKARMSRIGLAPLSTEQALAAFDAAMLVETPVLVAARLDRAALSENIAALPPLLRELAAGPTRRVIDDADVTASMSGLAARLHGLSPEARRRELVDLVCGNAAMVLGVPNPADINAGRAFQDLGFDSLTAVELRNRLKNATGLTLSPTLIFDYPTPVVLAEHLDSRLAGSGGDDQPDLMGRFNDITRELQALLGAAHWNSDDKAVLRTRIHGLLGALPAGDGPDSAPLDEDLEAATESQLFAILDEELGR

SEQ ID NO: 59 - protein, 2104 aa, Mycobacterium tuberculosis
MSGTTTHVDYLKRLTADLRRTRRRLSDLEAKLSEPVAVVGMGCRYPGGVDSPETLWELVAQGRDAVSDFPADRGWDVDGLFDPDPDACGKMYTRRGTFLEHAGDFDAGFFGIGPSEALAMDPQQRLLLEVSWEALERTGIDPTKLRGSATGVFAGVIHAGYGGQLSGELEGYGLTGSTLSVASGRVAYVLGLEGPAVSVDTACSSSLVALHLAVQSLRSGECDLALAGGVTVMATPAAFVEFSRQRALARDGRCKVYAGAADGTAWSEGAGVLVVERLVDARRLGHPVLALVRGSAVNQDGASNGLTAPNGPSQQRVIRAALASARLRAVEVDVVEGHGTGTMLGDPIEAQALLATYGQDRVEPLWLGSIKSNIGHTSAAAGVAGVIKMVQAMRHGVMPKTLHVDVPTPHVDWSVGAVSLLTQPRAWSVHGRPRRAGVSSFGISGTNAHVILEQAPVVESVVPEVASPTAASAVPWVLSARSEQALAGQAQRLLAFVAANPDLDPIDVGWSLVKTRAMFEHRAVVVGADRGALLAGLAALAAGESGAGVAVGRARSVGKTVFVFPGQGAQWVGMGAQLYAELPLFALAFDAVAEELDRHLRLPLRNVLWEGDEALLTSTEFAQPALFAIEVALATLLQHWGISPDFLIGHSVGEIAAAHLAGVLSLTDAAGLVAARGRLMAELPAGGVMVVVAASEEEVLPVLVDGANLAAVNAPHSVVVSGCEAAVSDIADHFARRGRRVHRLAVSHAFHSLLMEPMLAEFTRIAAGISVSKPRIPLVSNVTGQMAGAGYGDGQYWVEHARRPVRFAEGVQLLNAVGATRFVEVGPGGGLTALVEQSLPLGEALSVAMMRREHPEVSSVLGAVATLFTAGAQMDWPAVFGSPGRRIELPTYAFQRQRYWLPPTSAGSADISGVGLLAARHGLLGAVVEQPDSDVVVLTGRLSVGEQRWLADHVIAGVVLLAGAAFVELALRAADQVDCGVVEELTVVTPLVLPTVGGVQLQVVVGVGEMGQRPVSIYSRNAESDSGWVLHARGVLGAKAVAPAADLSVWPPLGAAPVDVDGAYQRFAELGYEYGRAFQGLTAMWRRESELFADVAVPDDVDVTLSGFGIHPLVLDAALHAMGMVGEQAATMLPFSWQGVSLHAAGASRVRARIAPAGDGTVSVELADQAGLPVLSVQALVMRSVSSQLLSAAVAAADAAGRGLLEVAWLPVELAHNDISADLVVWELESFQDGVGPVYSATHRVLVALQSWLAQERAGRLVVLTQGSVGQDATNLAGAAVWGLVRSAQAEHPGRVMLVDSDGSMDVGDVIGCGEEQLMIRNGTAYAARLAQLRPQPILQLPDTNSGWRLVAGGAGALEDLTLASCPAKELAPGQVRIEVRALGVNFRDVLVALGIYPGAAELGAEGAGVVTEVGPGVTGLAVGDPVMGLLGVAGSEAVVDARLVVKLPNRWPLTDAAGVPVVFLTAYYALRVLAQVQPGESVLVHAAAGGVGMAAVQLARLWGLEVFATASRGKWDTLHTMGCDNTHVADSRTLAFEETFWLTTEGRGVDVVLNSLAGEFTDASLRLLPRGGRFIEMGKTEFGTPRSLPRTILGWPTGLSTMEAGPQRIAQMLAELVELFKTEALHRLPVKSWDVRHAREAYRFLSQARHVGKVVLTMPDAWAAGTVLITGGTGMAGSAVARHLVSRYGVRQVVLASRAGEHTESVAALVDELGSAGARVQVVSCDVADRDAVAGLVASQPDLTAVFHAAGVLDDAVITGLTPERVDKVLRAKVDGAWNLHELTRHLDVSAFVLFSSMAGIVGAPGQANYAAANAFLDGLAAYRRSRGLAALSVAWGLWEQASAMTEHLGERDRVRMSRVGLAPLPTNQAMGFLDAALLADRPVVVAARLDRAALAGAELPALFSQLVAGPIRRIIDGADEVSGSGLASRLHGLTPEQRHRELTELVCSNAAIVLGHSGTEIDAHKAFQDLGFDSLTAVELRNRLKTATGLTLPPTLIFDYPTAAELAEHLDIQLANAPAVTVDQPNPSTRFNEVTRELQALLDQPNWNPDDKTRLIKRLQAILTDCTAPPASSGPSTTHDDEDITTATESQLFAILDDELGP

SEQ ID NO: 60 - protein, 2105 aa, Mycobacterium canettii
MSGTTTHVDYLKRLTADLRRTRRRLSDLEAKLSEPVAVVGMGCRYPGGVDSPETLWELVAQGRDAVSDFPADRGWDVDGLFDPDPDACGKMYTRRGTFLEHAGDFDAGFFGIGPSEALAMDPQQRLLLEVSWEALERTGIDPTKLRGSATGVFAGVIHAGYGGQLSGELEGYGLTGSTLSVASGRVAYVLGLEGPAVSVDTACSSSLVALHLAVQSLRSGECDLALAGGVTVMATPAAFVEFSRQRALARDGRCKVYAGAADGTAWSEGAGVLVVERLVDARRLGHPVLALVRGSAVNQDGASNGLTAPNGPSQQRVIRAALASARLRAVEVDVVEGHGTGTMLGDPIEAQALLATYGQDRVEPLWLGSIKSNIGHTSAAAGVAGVIKMVQAMRHGVMPKTLHVDVPTPHVDWSVGAVSLLTQPRAWSVHGRPRRAGVSSFGISGTNAHVILEQAPVVESVVPEVASPTAASAVPWVLSARSEQALAGQAQRLLAFVAANPDLDPIDVGWSLVKTRAMFEHRAVVVGADRGALLAGLAALAAGESGAGVAVGRARSVGKTVFVFPGQGAQWVGMGAQLYAELPLFALAFDAVAEELDRHLRLPLRKVLWEGDEALLTSTEFAQPALFAIEVALATLLQHWGISPDFLIGHSVGEIAAAHLAGVLSLTDAAGLVAARGRLMAELPAGGVMVVVAASEEEVLPVLVDGANLAAVNAPHSVVVSGCEAAVSDIADHFARRGRRVHRLAVSHAFHSLLMEPMLAEFTRIAAGISVSKPRIPLVSNVTGQMAGAGYGDGQYWVEHARRPVRFAEGVQLLNAVGATRFVEVGPGGGLTALVEQSLPLGEALSVAMMRREHPEVSSVLGAVATLFTAGAQMDWPAVFGSPGRRIELPTYAFQRQRYWLPPTSAGSADISGVGLLAARHGLLGAVVEQPDSDVVVLTGRLSVGEQRWLADHVIAGVVLLAGAAFVELALRAADQVDCGVVEELTVVTPLVLPTVGGVQLQVVVGVGEMGQRPVSIYSRNAESDSGWVLHARGVLGAKAVAPAADLSVWPPLGAAPVDVDGAYQRFAELGYEYGRAFQGLTAMWRRESELFADVAVPDDVDVTLSGFGIHPLVLDAALHAMGMVGEQAATMLPFSWQGVSLHAAGASRVRARIAPAGDGTVSVELADQAGLPVLSVQALVMRSVSSQLLSAAVAAADAAGRGLLEVAWLPVELAHNDISADLVVWELESFQDGVGPVYSATHRVLVALQSWLAQERAGRLVVLTQGSVGQDATNLAGAAVWGLVRSAQAEHPGRVMLVDSDGSMDVGDVIGCGEEQLMIRNGTAYAARLAQLRPQPILQLPDTNSGWRLVAGGAGTLEDLTLASCPAKELAPGQVRIEVRALGVNFRDVLVALGMYPGAAELGAEGAGVVTEVGPGVTGLAVGDPVMGLLGVAGSEAVVDARLVVKLPNRWPLTDAAGVPVVFLTAYYALRVLAQVQPGESVLVHAAAGGVGMAAVQLARLWGLEVFATASRGKWDTLHTMGCDNTHVADSRTLAFEETFWLTTEGRGVDVVLNSLAGEFTDASLRLLPRGGRFIEMGKTDVRDAQVVAQDHPGVAYRAFDLMEAGPQRIAQMLAELVELFKTEALHRLPVKSWDVRHAREAYRFLSQARHVGKVVLTMPDAWAAGTVLITGGTGMAGSAVARHLVSRYGVRQVVLASRAGEHTESVAALVDELGSAGARVQVVSCDVADRDAVAGLVASQPDLTAVFHAAGVLDDAVITGLTPDRVDKVLRAKVDGAWNLHELTRHLDVSAFVLFSSMAGIVGAPGQANYAAANAFLDGLAAYRRSRGLAALSVAWGLWEQASAMTEHLGERDRVRMSRVGLAPLPTNQAMGFLDAALLADRPVVVAARLDRAALAGAELPALFSQLVAGPIRRIIDGADEVSGSGLASRLHGLTPEQRHRELTELVCSNAAIVLGHSGTEIDAHKAFQDLGFDSLTAVELRNRLKTATGLTLPPTLIFDYPTAAELAEHLDIQLANAPAVTVDQPNPSTRFNEVTGELQALLDQPNWNPDDKTRLIKRLQAILTDCTAPPASSGPSTTHDDEDITTATESQLFAILDDELGP

SEQ ID NO: 61 - protein, 4151 aa, Mycobacterium tuberculosis
MVDQLQHATEALRKALVQVERLKRTNRALLERSSEPIAIVGMSCRFPGGVDSPEGLWQMVADARDVMSEFPTDRGWDLAGLFDPDPDVRHKSYARTGGFVDGVADFDPAFFGISPSEALAMDPQHRMLLELSWEALERAGIDPTGLRGSATGVFAGLIVGGYGMLAEEIEGYRLTGMTSSVASGRVAYVLGLEGPAVSVDTACSSSLVALHMAVGSLRSGECDLALAGGVTVNATPTVFVEFSRHRGLAPDGRCKPYAGRADGVGWSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGIELLDTAPAFAQQIDACAEAFAEFVDWSLVDVLRGAPGAPGLDRVDVVQPVLFAVMVSLAELWKSVAVHPDAVIGHSQGEIAAAYVAGALSLRDAARVVTLRSKLLAGLAGPGGMVSIACGADQARDLLAPFGDRVSIAVVNGPSAVVVSGEVGALEELIAVCSTKELRTRRIEVDYASHSVEVEAIRGPLAEALSGIEPRSTRTVFFSTVTGNRLDTAGLDADYWYRNVRQTVLFDQAVRNACEQGYRTFIESSPHPALITGVEETFAACTDGDSEAIVVPTLGRGDGGLHRFLLSAASAFVAGVAVNWRGTLDGAGYVELPTYAFDKRRFWLSAEGSGADVSGLGLGASEHPLLGAVVDLPASGGVVLTGRLSPNVQPWLADHAVSDVVLFPGTGFVELAIRAGDEVGCSVLDELTLAAPLLLPATGSVAVQVVVDAGRDSNSRGVSIFSRADAQAGWLLHAEGILRPGSVEPGADLSVWPPAGAVTVDVADGYERLATRGYRYGPAFRGLTAMWARGEEIFAEVRLPEAAGGVGGFGVHPALLDAVLHAVVIAGDPDELALPFAWQGVSLHATGASAVRARIAPAGPSAVSVELADGLGLPVLSVASMVARPVTERQLLAAVSGSGPDRLFEVIWSPASAATSPGPTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEPGRPRMHQYMLELATLFGDGVLRPLPVTTFDVRRAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLDAADLARLGREGVLALSTAEALELFDTAMIVDEPFLAPARIDLTALRAHAVAVPPMFSDLASAPTRRQVDDSVAAAKSKSALAHRLHGLPEAEQHAVLLGLVRLHIATVLGNITPEAIDPDKAFQDLGFDSLTAVEMRNRLKSATGLSLSPTLIFDYPTPNRLASYIRTELAGLPQEIKHTPAVRTTSEDPIAIVGMACRYPGGVNSPDDMWDMLIQGRDVLSEFPADRGWDLAGLYNPDPDAAGACYTRTGGFVDGVGDFDPAFFGVGPSEALAMDPQHRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGMGLHAGYPVFAEAFNTVVGELDRHLLRPLREVMWGHDENLLNSTEFAQPALFAVEVALFRLLGSWGVRPDFVMGHSIGELSAAHVAGVLSLENAAVLVAARGRLMQALPAGGAMVAVQAAEEEVRPLLSAEVDIAAVNGPASLVISGAQNAVAAVADQLRADGRRVHQLAVSHAFHSPLMDPMIDEFAAVAAGIAIGRPTIGVISNVTGQLAGDDFGSAAYWRRHIRQAVRFADSVRFAQAAGGSRFLEVGPSGGLVASIEESLPDVAVTTMSALRKDRPEPATLTNAVAQGFVTGMDLDWRAVVGEAQFVELPTYAFQRRRFWLSGDGVAADAAGLGLAASEHALLGAVIDLPASGGVVLTGRLSPSVQGWLADHSVAGVTIFPGAGFVELAIRAGDEVGCGVVDELTLAAPLVLPASGSVAVQVVVNGPDESGVRGVSVYSRGDVGTGWVLHAEGALRAGSAEPTADLAMWPPAGAVPVEVADGYQQLAERGYGYGPAFRGLTAMWRRGDEVFAEVALPADAGVSVTGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVCAWGTTEDSAAVVFESVPLAGDVVAGVYAATSSVLDVLQSWLTRDGAGVLVVMTRGAVALPGEDVTDLAGAAVWGLVRSAQTEHPGRIVLVDSDAPLDDSALAAVVTTGEPQVLWRRGEVYTARVHGSRAVGGLLVPPSDRPWRLAMSTAGTFENLRLELIPDADAPLGPGQVRVAVSAIAANFRDVMIALGLYPDPDAVMGVEACGVVIETSLNKGSFAVGDRVMGLFPEGTGTVASTDQRLLVKVPAGWSHTAAATTSVVFATAHYALVDLAAARSGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEPGPDRIAQILAELATLFGDGVLRPLPVTTFDVRCAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLATVDFKRFARDGIVAMSSADALQLFDTAMIVDEPFMLPAHIDFAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLALSPTLIFDYPNSAALAGYMRRELLGSSPQDTSAVAAGEAELQRIVASIPVKRLRQAGVLDLLLALANETETSGQDPALAPTAEQEIADMDLDDLVNAAFRNDDE

SEQ ID NO: 62 - protein, 4151 aa, Mycobacterium tuberculosis
MVDQLQHATEALRKALVQVERLKRTNRALLERSSEPIAIVGMSCRFPGGVDSPEGLWQMVADARDVMSEFPTDRGWDLAGLFDPDPDVRHKSYARTGGFVDGVADFDPAFFGISPSEALAMDPQHRMLLELSWEALERAGIDPTGLRGSATGVFAGLIVGGYGMLAEEIEGYRLTGMTSSVASGRVAYVLGLEGPAVSVDTACSSSLVALHMAVGSLRSGECDLALAGGVTVNATPTVFVEFSRHRGLAPDGRCKPYAGRADGVGWSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGIELLDTAPAFAQQIDACAEAFAEFVDWSLVDVLRGAPGAPGLDRVDVVQPVLFAVMVSLAELWKSVAVHPDAVIGHSQGEIAAAYVAGALSLRDAARVVTLRSKLLAGLAGPGGMVSIACGADQARDLLAPFGDRVSIAVVNGPSAVVVSGEVGALEELIAVCSTKELRTRRIEVDYASHSVEVEAIRGPLAEALSGIEPRSTRTVFFSTVTGNRLDTAGLDADYWYRNVRQTVLFDQAVRNACEQGYRTFIESSPHPALITGVEETFAACTDGDSEAIVVPTLGRGDGGLHRFLLSAASAFVAGVAVNWRGTLDGAGYVELPTYAFDKRRFWLSAEGSGADVSGLGLGASEHPLLGAVVDLPASGGVVLTGRLSPNVQPWLADHAVSDVVLFPGTGFVELAIRAGDEVGCSVLDELTLAAPLLLPATGSVAVQVVVDAGRDSNSRGVSIFSRADAQAGWLLHAEGILRPGSVEPGADLSVWPPAGAVTVDVADGYERLATRGYRYGPAFRGLTAMWARGEEIFAEVRLPEAAGGVGGFGVHPALLDAVLHAVVIAGDPDELALPFAWQGVSLHATGASAVRARIAPAGPSAVSVELADGLGLPVLSVASMVARPVTERQLLAAVSGSGPDRLFEVIWSPASAATSPGPTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEPGRPRMHQYMLELATLFGDGVLRPLPVTTFDVRRAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLDAADLARLGREGVLALSTAEALELFDTAMIVDEPFLAPARIDLTALRAHAVAVPPMFSDLASAPTRRQVDDSVAAAKSKSALAHRLHGLPEAEQHAVLLGLVRLHIATVLGNITPEAIDPDKAFQDLGFDSLTAVEMRNRLKSATGLSLSPTLIFDYPTPNRLASYIRTELAGLPQEIKHTPAVRTTSEDPIAIVGMACRYPGGVNSPDDMWDMLIQGRDVLSEFPADRGWDLAGLYNPDPDAAGACYTRTGGFVDGVGDFDPAFFGVGPSEALAMDPQQRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGMGLHAGYPVFAEAFNTVVGELDRHLLRPLREVMWGHDENLLNSTEFAQPALFAVEVALFRLLGSWGVRPDFVMGHSIGELSAAHVAGVLSLENAAVLVAARGRLMQALPAGGAMVAVQAAEEEVRPLLSAEVDIAAVNGPASLVISGAQNAVAAVADQLRADGRRVHQLAVSHAFHSPLMDPMIDEFAAVAAGIAIGRPTIGVISNVTGQLAGDDFGSAAYWRRHIRQAVRFADSVRFAQAAGGSRFLEVGPSGGLVASIEESLPDVAVTTMSALRKDRPEPATLTNAVAQGFVTGMDLDWRAVVGEAQFVELPTYAFQRRRFWLSGDGVAADAAGLGLAASEHALLGAVIDLPASGGVVLTGRLSPSVQGWLADHSVAGVTIFPGAGFVELAIRAGDEVGCGVVDELTLAAPLVLPASGSVAVQVVVNGPDESGVRGVSVYSRGDVGTGWVLHAEGALRAGSAEPTADLAMWPPAGAVPVEVADGYQQLAERGYGYGPAFRGLTAMWRRGDEVFAEVALPADAGVSVTGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVCAWGTTEDSAAVVFESVPLAGDVVAGVYAATSSVLDVLQSWLTRDGAGVLVVMTRGAVALPGEDVTDLAGAAVWGLVRSAQTEHPGRIVLVDSDAPLDDSALAAVVTTGEPQVLWRRGEVYTARVHGSRAVGGLLVPPSDRPWRLAMSTAGTFENLRLELIPDADAPLGPGQVRVAVSAIAANFRDVMIALGLYPDPDAVMGVEACGVVIETSLNKGSFAVGDRVMGLFPEGTGTVASTDQRLLVKVPAGWSHTAAATTSVVFATAHYALVDLAAARSGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFGDGVLRPLPVTTFDVRCAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLATVDFKRFARDGIVAMSSADALQLFDTAMIVDEPFMLPAHIDFAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLALSPTLIFDYPNSAALAGYMRRELLGSSPQDTSAVAAGEAELQRIVASIPVKRLRQAGVLDLLLALANETETSGQDPALAPTAEQEIADMDLDDLVNAAFRNDDE

SEQ ID NO: 63 - protein, 4151 aa, Mycobacterium tuberculosis
MVDQLQHATEALRKALVQVERLKRTNRALLERSSEPIAIVGMSCRFPGGVDSPEGLWQMVADARDVMSEFPTDRGWDLAGLFDPDPDVRHKSYARTGGFVDGVADFDPAFFGISPSEALAMDPQHRMLLELSWEALERAGIDPTGLRGSATGVFAGLIVGGYGMLAEEIEGYRLTGMTSSVASGRVAYVLGLEGPAVSVDTACSSSLVALHMAVGSLRSGECDLALAGGVTVNATPTVFVEFSRHRGLAPDGRCKPYAGRADGVGWSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGIELLDTAPAFAQQIDACAEAFAEFVDWSLVDVLRGAPGAPGLDRVDVVQPVLFAVMVSLAELWKSVAVHPDAVIGHSQGEIAAAYVAGALSLRDAARVVTLRSKLLAGLAGPGGMVSIACGADQARDLLAPFGDRVSIAVVNGPSAVVVSGEVGALEELIAVCSTKELRTRRIEVDYASHSVEVEAIRGPLAEALSGIEPRSTRTVFFSTVTGNRLDTAGLDADYWYRNVRQTVLFDQAVRNACEQGYRTFIESSPHPALITGVEETFAACTDGDSEAIVVPTLGRGDGGLHRFLLSAASAFVAGVAVNWRGTLDGAGYVELPTYAFDKRRFWLSAEGSGADVSGLGLGASEHPLLGAVVDLPASGGVVLTGRLSPNVQPWLADHAVSDVVLFPGTGFVELAIRAGDEVGCSVLDELTLAAPLLLPATGSVAVQVVVDAGRDSNSRGVSIFSRADAQAGWLLHAEGILRPGSVEPGADLSVWPPAGAVTVDVADGYERLATRGYRYGPAFRGLTAMWARGEEIFAEVRLPEAAGGVGGFGVHPALLDAVLHAVVIAGDPDELALPFAWQGVSLHATGASAVRARIAPAGPSAVSVELADGLGLPVLSVASMVARPVTERQLLAAVSGSGPDRLFEVIWSPASAATSPGPTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEPGRPRMHQYMLELATLFGDGVLRPLPVTTFDVRRAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLDAADLARLGREGVLALSTAEALELFDTAMIVDEPFLAPARIDLTALRAHAVAVPPMFSDLASAPTRRQVDDSVAAAKSKSALAHRLHGLPEAEQHAVLLGLVRLHIATVLGNITPEAIDPDKAFQDLGFDSLTAVEMRNRLKSATGLSLSPTLIFDYPTPNRLASYIRTELAGLPQEIKHTPAVRTTSEDPIAIVGMACRYPGGVNSPDDMWDMLIQGRDVLSEFPADRGWDLAGLYNPDPDAAGACYTRTGGFVDGVGDFDPAFFGVGPSEALAMDPQQRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGMGLHAGYPVFAEAFNTVVGELDRHLLRPLREVMWGHDENLLNSTEFAQPALFAVEVALFRLLGSWGVRPDFVMGHSIGELSAAHVAGVLSLENAAVLVAARGRLMQALPAGGAMVAVQAAEEEVRPLLSAEVDIAAVNGPASLVISGAQNAVAAVADQLRADGRRVHQLAVSHAFHSPLMDPMIDEFAAVAAGIAIGRPTIGVISNVTGQLAGDDFGSAAYWRRHIRQAVRFADSVRFAQAAGGSRFLEVGPSGGLVASIEESLPDVAVTTMSALRKDRPEPATLTNAVAQGFVTGMDLDWRAVVGEAQFVELPTYAFQRRRFWLSGDGVAADAAGLGLAASEHALLGAVIDLPASGGVVLTGRLSPSVQGWLADHSVAGVTIFPGAGFVELAIRAGDEVGCGVVDELTLAAPLVLPASGSVAVQVVVNGPDESGVRGVSVYSRGDVGTGWVLHAEGALRAGSAEPTADLAMWPPAGAVPVEVADGYQQLAERGYGYGPAFRGLTAMWRRGDEVFAEVALPADAGVSVTGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVCAWGTTEDSAAVVFESVPLAGDVVAGVYAATSSVLDVLQSWLTRDGAGVLVVMTRGAVALPGEDVTDLAGAAVWGLVRSAQTEHPGRIVLVDSDAPLDDSALAAVVTTGEPQVLWRRGEVYTARVHGSRAVGGLLVPPSDRPWRLAMSTAGTFENLRLELIPDADAPLGPGQVRVAVSAIAANFRDVMIALGLYPDPDAVMGVEACGVVIETSLNKGSFAVGDRVMGLFPEGTGTVASTDQRLLVKVPAGWSHTAAATTSVVFATAHYALVDLAAARSGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFGDGVLRPLPVTTFDVRCAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWYLHELTRDLDVSAFVMFSSMAGLVGSSGQANYAAANSFLDALAAHRRAHGLPAISLGWGLWDQASAMTGGLATVDFKRFARDGIVAMSSADALQLFDTAMIVDEPFMLPAHIDFAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLALSPTLIFDYPNSAALAGYMRRELLGSSPQDTSAVAAGEAELQRIVASIPVKRLRQAGVLDLLLALANETETSGQDPALAPTAEQEIADMDLDDLVNAAFRNDDE

SEQ ID NO: 64 - protein, 4151 aa, Mycobacterium tuberculosis
MVDQLQHATEALRKALVQVERLKRTNRALLERSSEPIAIVGMSCRFPGGVDSPEGLWQMVADARDVMSEFPTDRGWDLAGLFDPDPDVRHKSYARTGGFVDGVADFDPAFFGISPSEALAMDPQHRMLLELSWEALERAGIDPTGLRGSATGVFAGLIVGGYGMLAEEIEGYRLTGMTSSVASGRVAYVLGLEGPAVSVDTACSSSLVALHMAVGSLRSGECDLALAGGVTVNATPTVFVEFSRHRGLAPDGRCKPYAGRADGVGWSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGIELLDTAPAFAQQIDACAEAFAEFVDWSLVDVLRGAPGAPGLDRVDVVQPVLFAVMVSLAELWKSVAVHPDAVIGHSQGEIAAAYVAGALSLRDAARVVTLRSKLLAGLAGPGGMVSIACGADQARDLLAPFGDRVSIAVVNGPSAVVVSGEVGALEELIAVCSTKELRTRRIEVDYASHSVEVEAIRGPLAEALSGIEPRSTRTVFFSTVTGNRLDTAGLDADYWYRNVRQTVLFDQAVRNACEQGYRTFIESSPHPALITGVEETFAACTDGDSEAIVVPTLGRGDGGLHRFLLSAASAFVAGVAVNWRGTLDGAGYVELPTYAFDKRRFWLSAEGSGADVSGLGLGASEHPLLGAVVDLPASGGVVLTGRLSPNVQPWLADHAVSDVVLFPGTGFVELAIRAGDEVGCSVLDELTLAAPLLLPATGSVAVQVVVDAGRDSNSRGVSIFSRADAQAGWLLHAEGILRPGSVEPGADLSVWPPAGAVTVDVADGYERLATRGYRYGPAFRGLTAMWARGEEIFAEVRLPEAAGGVGGFGVHPALLDAVLHAVVIAGDPDELALPFAWQGVSLHATGASAVRARIAPAGPSAVSVELADGLGLPVLSVASMVARPVTERQLLAAVSGSGPDRLFEVIWSPASAATSPGPTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEPGRPRMHQYMLELATLFGDGVLRPLPVTTFDVRCAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLDAADLARLGREGVLALSTAEALELFDTAMIVDEPFLAPARIDLTALRAHAVAVPPMFSDLASAPTRRQVDDSVAAAKSKSALAHRLHGLPEAEQHAVLLGLVRLHIATVLGNITPEAIDPDKAFQDLGFDSLTAVEMRNRLKSATGLSLSPTLIFDYPTPNRLASYIRTELAGLPQEIKHTPAVRTTSEDPIAIVGMACRYPGGVNSPDDMWDMLIQGRDVLSEFPADRGWDLAGLYNPDPDAAGACYTRTGGFVDGVGDFDPAFFGVGPSEALAMDPQQRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGMGLHAGYPVFAEAFNTVVGELDRHLLRPLREVMWGHDENLLNSTEFAQPALFAVEVALFRLLGSWGVRPDFVMGHSIGELSAAHVAGVLSLENAAVLVAARGRLMQALPAGGAMVAVQAAEEEVRPLLSAEVDIAAVNGPASLVISGAQNAVAAVADQLRADGRRVHQLAVSHAFHSPLMDPMIDEFAAVAAGIAIGRPTIGVISNVTGQLAGDDFGSAAYWRRHIRQAVRFADSVRFAQAAGGSRFLEVGPSGGLVASIEESLPDVAVTTMSALRKDRPEPATLTNAVAQGFVTGMDLDWRAVVGEAQFVELPTYAFQRRRFWLSGDGVAADAAGLGLAASEHALLGAVIDLPASGGVVLTGRLSPSVQGWLADHSVAGVTIFPGAGFVELAIRAGDEVGCGVVDELTLAAPLVLPASGSVAVQVVVNGPDESGVRGVSVYSRGDVGTGWVLHAEGALRAGSAEPTADLAMWPPAGAVPVEVADGYQQLAERGYGYGPAFRGLTAMWRRGDEVFAEVALPADAGVSVTGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVCAWGTTEDSAAVVFESVPLAGDVVAGVYAATSSVLDVLQSWLTRDGAGVLVVMTRGAVALPGEDVTDLAGAAVWGLVRSAQTEHPGRIVLVDSDAPLDDSALAAVVTTGEPQVLWRRGEVYTARVHGSRAVGGLLVPPSDRPWRLAMSTAGTFENLRLELIPDADAPLGPGQVRVAVSAIAANFRDVMIALGLYPDPDAVMGVEACGVVIETSLNKGSFAVGDRVMGLFPEGTGTVASTDQRLLVKVPAGWSHTAAATTSVVFATAHYALVDLAAARSGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFGDGVLRPLPVTTFDVRCAPAALRYLSQARHTGKVVMLMPGSWAAGTVLITGGTGMAGSAVARHVVARHGVRNLVLVSRRGPDAPGAAELVAELAAAGAQVQVLACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLATVDFKRFARDGIVAMSSADALQLFDTAMIVDEPFMLPAHIDFAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLALSPTLIFDYPNSAALAGYMRRELLGSSPQDTSAVAAGEAELQRIVASIPVKRLRQAGVLDLLLALANETETSGQDPALAPTAEQEIADMDLDDLVNAAFRNDDE

SEQ ID NO: 65 - protein, 4151 aa, Mycobacterium tuberculosis
MVDQLQHATEALRKALVQVERLKRTNRALLERSSEPIAIVGMSCRFPGGVDSPEGLWQMVADARDVMSEFPTDRGWDLAGLFDPDPDVRHKSYARTGGFVDDVADFDPAFFGISPSEALAMDPQHRMLLELSWEALERAGIDPTGLRGSATGVFAGLIVGGYGMLAEEIEGYRLTGMTSSVASGRVAYVLGLEGPAVSVDTACSSSLVALHMAVGSLRSGECDLALAGGVTVNATPTVFVEFSRHRGLAPDGRCKPYAGRADGVGWSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGIELLDTAPAFAQQIDACAEAFAEFVDWSLVDVLRGAPGAPGLDRVDVVQPVLFAVMVSLAELWKSVAVHPDAVIGHSQGEIAAAYVAGALSLRDAARVVTLRSKLLAGLAGPGGMVSIACGADQARDLLAPFGDRVSIAVVNGPSAVVVSGEVGALEELIAVCSTKELRTRRIEVDYASHSVEVEAIRGPLAEALSGIEPRSTRTVFFSTVTGNRLDTAGLDADYWYRNVRQTVLFDQAVRNACEQGYRTFIESSPHPALITGVEETFAACTDGDSEAIVVPTLGRGDGGLHRFLLSAASAFVAGVAVNWRGTLDGAGYVELPTYAFDKRRFWLSAEGSGADVSGLGLGASEHPLLGAVVDLPASGGVVLTGRLSPNVQPWLADHAVSDVVLFPGTGFVELAIRAGDEVGCSVLDELTLAAPLLLPATGSVAVQVVVDAGRDSNSRGVSIFSRADAQAGWLLHAEGILRPGSVEPGADLSVWPPAGAVTVDVADGYERLATRGYRYGPAFRGLTAMWARGEEIFAEVRLPEAAGGVGGFGVHPALLDAVLHAVVIAGDPDELALPFAWQGVSLHATGASAVRARIAPAGPSAVSVELADGLGLPVLSVASMVARPVTERQLLAAVSGSGPDRLFEVIWSPASAATSPGPTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEPGRPRMHQYMLELATLFGDGVLRPLPVTTFDVRCAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLDAADLARLGREGVLALSTAEALELFDTAMIVDEPFLAPARIDLTALRAHAVAVPPMFSDLASAPTRRQVDDSVAAAKSKSALAHRLHGLPEAEQHAVLLGLVRLHIATVLGNITPEAIDPDKAFQDLGFDSLTAVEMRNRLKSATGLSLSPTLIFDYPTPNRLASYIRTELAGLPQEIKHTPAVRTTSEDPIAIVGMACRYPGGVNSPDDMWDMLIQGRDVLSEFPADRGWDLAGLYNPDPDAAGACYTRTGGFVDGVGDFDPAFFGVGPSEALAMDPQQRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGMGLHAGYPVFAEAFNTVVGELDRHLLRPLREVMWGHDENLLNSTEFAQPALFAVEVALFRLLGSWGVRPDFVMGHSIGELSAAHVAGVLSLENAAVLVAARGRLMQALPAGGAMVAVQAAEEEVRPLLSAEVDIAAVNGPASLVISGAQNAVAAVADQLRADGRRVHQLAVSHAFHSPLMDPMIDEFAAVAAGIAIGRPTIGVISNVTGQLAGDDFGSAAYWRRHIRQAVRFADSVRFAQAAGGSRFLEVGPSGGLVASIEESLPDVAVTTMSALRKDRPEPATLTNAVAQGFVTGMDLDWRAVVGEAQFVELPTYAFQRRRFWLSGDGVAADAAGLGLAASEHALLGAVIDLPASGGVVLTGRLSPSVQGWLADHSVAGVTIFPGAGFVELAIRAGDEVGCGVVDELTLAAPLVLPASGSVAVQVVVNGPDESGVRGVSVYSRGDVGTGWVLHAEGALRAGSAEPTADLAMWPPAGAVPVEVADGYQQLAERGYGYGPAFRGLTAMWRRGDEVFAEVALPADAGVSVTGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVCAWGTTEDSAAVVFESVPLAGDVVAGVYAATSSVLDVLQSWLTRDGAGVLVVMTRGAVALPGEDVTDLAGAAVWGLVRSAQTEHPGRIVLVDSDAPLDDSALAAVVTTGEPQVLWRRGEVYTARVHGSRAVGGLLVPPSDRPWRLAMSTAGTFENLRLELIPDADAPLGPGQVRVAVSAIAANFRDVMIALGLYPDPDAVMGVEACGVVIETSLNKGSFAVGDRVMGLFPEGTGTVASTDQRLLVKVPAGWSHTAAATTSVVFATAHYALVDLAAARSGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFGDGVLRPLPVTTFDVRCAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTGGLATVDFKRFARDGIVAMSSADALQLFDTAMIVDEPFMLPAHIDFAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLALSPTLIFDYPNSAALAGYMRRELLGSSPQDTSAVAAGEAELQRIVASIPVKRLRQAGVLDLLLALANETETSGQDPALAPTAEQEIADMDLDDLVNAAFRNDDE

SEQ ID NO: 66 - protein, 4151 aa, Mycobacterium bovis
MVDQLQHATEALRKALVQVERLKRTNRALLERSSEPIAIVGMSCRFPGGVDSPEGLWQMVADARDVMSEFPTDRGWDLAGLFDPDPDVRHKSYARTGGFVDGVADFDPAFFGISPSEALAMDPQHRMLLELSWEALERAGIDPTGLRGSATGVFAGLIVGGYGMLAEEIEGYRLTGMTSSVASGRVAYVLGLEGPAVSVDTACSSSLVALHMAVGSLRSGECDLALAGGVTVNATPTVFVEFSRHRGLAPDGRCKPYAGRADGVGWSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGIELLDTAPAFAQQIDACAEAFAEFVDWSLVDVLRGAPGAPGLDRVDVVQPVLFAVMVSLAELWKSVAVHPDAVIGHSQGEIAAAYVAGALSLRDAARVVTLRSKLLAGLAGPGGMVSIACGADQARDLLAPFGDRVSIAVVNGPSAVVVSGEVGALEELIAVCSTKELRTRRIEVDYASHSVEVEAIRGPLAEALSGIEPRSTRTVFFSTVTGNRLDTAGLDADYWYRNVRQTVLFDQAVRNACEQGYRTFIESSPHPALITGVEETFAACTDGDSEAIVVPTLGRGDGGLHRFLLSAASAFVAGVAVNWRGTLDGAGYVELPTYAFDKRRFWLSAEGSGADVSGLGLGASEHPLLGAVVDLPASGGVVLTGRLSPNVQPWLADHAVSDVVLFPGTGFVELAIRAGDEVGCSVLDELTLAAPLLLPATGSVAVQVVVDAGRDSNSRGVSIFSRADAQAGWLLHAEGILRPGSVEPGADLSVWPPAGAVTVDVADGYERLATRGYRYGPAFRGLTAMWARGEEIFAEVRLPEAAGGVGGFGVHPALLDAVLHAVVIAGDPDELALPFAWQGVSLHATGASAVRARIAPAGPSAVSVELADGLGLPVLSVASMVARPVTERQLLAAVSGSGPDRLFEVIWSPASAATSPGPTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFGDGVLRLLPVTTFDVRRAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTSGLDAADLARLGREGVLALSTAEALELFDTAMIVDEPFLAPARIDLTALRAHAVAVPPMFSDLASAPTRRQVDDSVAAAKSKSALAHRLHGLPEAEQHAVLLGLVRLHIATVLGNITPEAIDPDKAFQDLGFDSLTAVEMRNRLKSATGLSLSPTLIFDYPTPNRLASYIRTELAGLPQEIKHTPAVRTTSEDPIAIVGMACRYPGGVNSPDDMWDMLIQGRDVLSEFPADRGWDLAGLYNPDPDAAGACYTRTGGFVDGVGDFDPAFFGVGPSEALAMDPQQRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGMGLHAGYPVFAEAFNTVVGELDRHLLRPLREVMWGHDENLLNSTEFAQPALFAVEVALFRLLGSWGVRPDFVMGHSIGELSAAHVAGVLSLENAAVLVAARGRLMQALPAGGAMVAVQAAEEEVRPLLSAEVDIAAVNGPASLVISGAQNAVAAVADQLRADGRRVHQLAVSHAFHSPLMDPMIDEFAAVAAGIAIGRPTIGVISNVTGQLAGDDFGSAAYWRRHIRQAVRFADSVRFAQAAGGSRFLEVGPSGGLVASIEESLPDVAVTTMSALRKDRPEPATLTNAVAQGFVTGMDLDWRAVVGEAQFVELPTYAFQRRRFWLSGDGVAADAAGLGLAASEHALLGAVIDLPASGGVVLTGRLSPRVQGWLADHSVAGVTIFPGAGFVELAIRAGDEVGCGVVDELTLAAPLVLPASGSVAVQVVVNGPDESGVRGVSVYSRGDVGTGWVLHAEGALRAGSAEPTADLAMWPPAGAVPVEVADGYQQLAERGYGYGLAFRGLTAMWRRGDEVFAEVALPADAGVSVTGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVCAWGTTEDSAAVVFESVPLAGDVVAGVYAATSSVLDVLQSWLTRDGAGVLVVMTRGAVALPGEDVTDLAGAAVWGLVRSAQTEHPGRIVLVDSDAPLDDSALAAVVTTGEPQVLWRRGEVYTARVHGSRAVGGLLVPPSDRPWRLAMSTAGTFENLRLELIPDADAPLGPGQVRVAVSAIAANFRDVMIALGLYPDPDAVMGVEACGVVIETSLNKGSFAVGDRVMGLFPEGTGTVASTDQRLLVKVPAGWSHTAAATTSVVFATAHYALVDLAAARSGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFGDGVLRPLPVTTFDVRRAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVMSLTPDRVDVVLRSKVDAAWHLHELTRDLDVSAFVMFSSMAGLVGSSGQANYAAANSFLDALAAHRRAHGLPAISLGWGLWDQASAMTSGLATVDFKRFARDGIVAMSSADALQLFDTAMIVDEPFMLPAHIDFAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLSLSPTLIFDYPNSAALAGYMRRELLGSSPQDTSAVAAGEAELQRIVASIPVKRLRQAGVLDLLLALANETETSGQDPALAPTAEQEIADMDLDDLVNAAFRNDDE

SEQ ID NO: 67 - protein, 4154 aa, Mycobacterium canettii
MVDQLQHATEALRKALVQVERLKRTNRALLERSSEPIAIVGMSCRFPGGVDSPEGLWQMVAEGRDVISGFPTDRGWDLAGLFDPDPDARHKSYARTGGFVDGVADFDPAFFGISPSEALAMDPQHRMLLELSWEALERAGIDPTGLRGSATGVFAGLIVGGYGMLAEEIEGYRLTGMTSSVASGRVAYVLGLEGPAVSVDTACSSSLVALHMAVGSLRSGECDLALAGGVTVNATPTVFVEFSRHRGLAPDGRCKPYGGAADGVGWSEGGGMLALERLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATPAGKTVFVFPGQGSQWLGMGIELLDTAPAFAQQIDACAEAFAEFVDWSLVDVLRGAPGAPGLDRVDVVQPVLFAVMVSLAELWKSVAVRPDAVIGHSQGEIAAAYVAGALSLRDAARVVTLRSKLLAGLAGPGGMVSIACGADQARDLLAPFGDRVSIAVVNGPSAVVVSGEVGALEELIALCSTKELRTRRIEVDYASHSVEVEAIRGPLAEALSGIEPRPTRTVFFSTVTGNRLDTAGLDADYWYRNVRQTVLFDQAVRNACEQGYRTFIESSPHPALITGVEETFAACTDGDSEAIVVPTLGRGDGGLHRFLLSTASAFVAGVAVDWRGTLDGAGYVELPTYAFDKRRFWLSAEGSGADAFGLGLGASEHPLLGAVVDLPASGGMVLMVLTGRLSPNVQPWLADHAVSDVVLFPGTGFVELAIRAGDEVGCSVLDELTLAAPLLLPATGSVAVQVVVDAGRDSNSRGVSIFSRADAQAGWLLHAEGILRPGSVEPGADLSVWPPAGAVAVDVADGYERLATCGYRYGPAFRGLTAMWARGEEIFAEVRLPEAAGGVGGFGVHPALLDAVLHAVVIAGDPDELALPFAWQGVSLHATGASAVRARIAPAGPSAVSVELADGLGLPVLSVASMVARPVTERQLLAAVSGSGPDRLFEVIWSRASGVTALGSTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLIHAATGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEPGRPRMHQYMLELATLFGDGVLRPLPVTTFDVRRAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHPLSGVIHTAGALDDAVVTSLTPDRVDVVLRSKVDAAWHLHELTRDLDVSAFVMFSSMAGLVGSSGQANYAAANSFLDALAAHRRAHGLPAISLGWGLWDQASAMTGGLDAADLARLGREGVLALSTAEALELFDTAMIVDEPFLAPARIDLTALRAHAVAVPPMFSDLASAPTRRQVDDSVAAAKSKSALAHRLHGLPEAEQHAVLLGLVRLHIATVLGNITPEAIDPDKAFQDLGFDSLTAVEMRNRLKSATGLSLSPTLIFDYPTPNRLASYIRTELAGLPQEIKHTPAVRTTSEDPIAIVGMACRYPGGVNSPDDMWDMLIQGRDVLSEFPGDRGWDLAGLYNPDPDAAGACYTRTGGFVDGVGDFDPAFFGVGPSEALAMDPQQRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLQRLSDARRLGHPVLAVVVGSAVNQDGASNGLTAPNGPSQQRVVRAALANAGLSAAEVDVVEGHGTGTTLGDPIEAQALLATYGQDRGEPGEPLWLGSVKSNMGHTQAAAGVAGVIKMVLAMRHELLPATLHVDVPSPHVDWSAGAVELLTAPRVWPAGARTRRAGVSSFGISGTNAHVIIEAVPVVPRREAGWAGPVVPWVVSAKSESALRGQAARLAAYVRGDDGLDVADVGWSLAGRSVFEHRAVVVGGDRDRLLAGLDELAGDQLGGSVVRGTATAAGKTVFVFPGQGSQWLGMGMGLHAGYPVFAEAFNTVVGELDRHLLRPLREVMWGHDENLLNSTEFAQPALFAVEVALFRLLGSWGVRPDFVMGHSIGELSAAHVAGVLSLENAAVLVAARGRLMQALPAGGAMVAVQAAEEEVRPLLSAEVDIAAVNGPASLVISGAQNAVAAVADQLRADGRRVHQLAVSHAFHSPLMDPMIDEFAAVAAGIAIGRPTIGIISNVTGQLAGDDFGSAAYWRRHIRQAVRFADSVRFAQAAGGSRFLEVGPSGGLVASIEESLPDVAVTTMSALRKDRPEPATLTNAVAQGFVTGMDLDWRAVVGEAQFVELPTYAFQRRRFWLSGDGVAADAAGLGLAASEHALLGAVIDLPASGGVVLTGRLSPSVQGWLADHSVAGVTIFPGAGFVELAIRAGDEVGCGVVDELTLAAPLVLPASGSVAVQVVVNGPDESGVRGVSVYSRGDVGTGWVLHAEGALRAGSAEPTADLAMWPPAGAVPVEVADGYQQLAERGYGYGPAFRGLTAMWRRGDEVFAEVALPADAGVSVTGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVCAWGTTEDSAAVVFESVPLAGDVVAGVYAATSSVLDVLQSWLTRDGAGVLVVMTRGAVALPGEDVTDLAGAAVWGLVRSAQTEHPGRIVLVDSDAPLDDSALAAVVTTGEPQVLWRRGEVYTARVHGSRAVGGLLVPPSDRPWRLAMSTAGTFENLRLELIPDADAPLGPGQVRVAVSAIAANFRDVMIALGLYPDPDAVMGVEACGVVIETSLNKGSFAVGDRVMGLFPEGTGTVASTDQRLLVKVPAGWSHTAAATTSVVFATAHYALVDLAAARSGQRVLIHAGTGGVGMAAVQLARHLGLEVFATASKGKWDTLRAMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFGDGVLRPLPVTTFDVRRAPAALRYLSQARHTGKVVMLMPGSWAAGTVLITGGTGMAGSAVARHVVARHGVRNLVLVSRRGPDAPGAAELVAELAAAGAQVQVVACDAADRAALAKVIADIPVQHRLSGVIHAAGALDDAVVTSLTPDRVDVVLRSKVDAAWHLHELTRDLDVSAFVMFSSMAGLVGSSGQANYAAANSFLDALAAHRRAHGLPAISLGWGLWDQASAMTGGLATVDFKRFARDGIVAMSSADALQLFDTAMIVDEPFMLPAHIDFAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLALSPTLIFDYPNSAALAGYMRRELLGSSPQDTSAVAAGEAELQRIVASIPVKRLRQAGVLDLLLALANETETSGQDPALAPTAEQEIADMDLDDLVNAAFRNDDE

SEQ ID NO: 68 - protein, 4187 aa, Mycobacterium marinum
MVDQLQHATEALRKALVQVERLKRTNRALLERSSEPIAIVGMSCRFPGGVDSPEGLWQMVAEGRDVMSDFPTDRGWDLADLFDPDPDTPHKSYASTGGFVDGVADFDPGFFGIAPSEALAMDPQHRMLLELSWEALERSGIDPTGLRGSATGVFAGLIVQGYGMFAEEIEGYRLTGMTSSVASGRVAYVLGLEGPAVSVDTACSSSLVALHMAVQSLRSGECDLALAGGATVNATPTVFVEFSRHRGLAPDGRSKAYAGAADGVGWSEGGAMLVVERLSDAQRLGHPVLALVRGSAVNQDGASNGLTAPNGPSQQRVVRAALANAGLSAAEVDVVEGHGTGTTLGDPIEAQALLATYGQDRGSAGAAGKALWLGSIKSNMGHTQAAAGVAGVIKMVQAMRHEVLPATLHVDVPSPHVDWSAGAVELLTEAQPWPAESAGDRVRRAGVSSFGISGTNAHVIVEAAPRVEVGGSSGGAVPVVPWVVSAKSGSALGAQAARLAAHVRSHDELDVADVGWSLAGRSTFEHRAVVLGVDRDGLLAGLDELAGDEFGGASVIRGVAGAAGKTVFVFPGQGSQWIGMGIELLDTAPVFARHIESCGQAFAEFVDWSLLDVLRGAAGAPGLDRVDVVQPVLFAVMVSLAELWKSVGVRPDAVIGHSQGEIAAAYVAGALSLRDAAKVVTLRSKLLVGLAGPGGMVSVACGEQQARELLEPFGDRVSIAAINGPSAVVVSGEVAALEELIAQCADRELRTRRIDVDYASHSVEVEAIEGQLTEVLAGIEPLSSRTAFFSSVTGSRLDTAELDAEYWYRNIRQTVQFDQAVRSACGHGYRTFIESSPHPALIAGIEDTYRNCAADSGADPIVVPTLGREDGGLQRFLASAAAAFVAGVNVDWRGPLDGAGLVELPTYAFEKRRFWLSGEGVSVDASGLGLSAGGHALLGAVVELPESGGVVLTGRLALGAHGWLADHAVSGVVVFPGTGFVELAIRAGDEVGCSVVNELTLRTPLVLPASGSVAVQVVVGAAADSAERSVSIYSRTDTDAGSVWVCHAEGTLGADSAQPAADLSAWPPAGAIAVDVADGYERLDARGYGYGPAFRGLTAMWARGEELFAEVRLPEAAGSTSGFGVHPALLDAALHTAVIANPDAELVLPFSWQGVSLHAAGAASVRVRIAPVGPSSVSVELADDLGLPVLSVKAMVARPVSEQQMRAVVSASGPDRLFEVVWTPMTVAATDAAPAYELFESVAAEGDPLSGTYQRTHQALAAVQSWLTEHDSGVLVVATRGAMALAGEDVTDLAGAAVWGLVRSAQTENPGRLVLVDSDAAVDAAAVATALAVGEPQVVLRNGQPYTARVHASRAADGILVPPVDGPWRLGLSSAGTFENLQLEPVPNAGAPLGPGQVRVAMRAIAANFRDIMITLGMFTHDALIGGEGAGVVVEIGPEVTEFAVGDAVYGFFPDGSGTLVAGDVRLLLPKPADWSYAEAAAISAVFTTAYYAFVHLANVQPGQRVLVHAATGGVGMAAVQLARHLGLEVYATASKGKWDILRAMGFDEDHISDSRSLEFEEKFREVTGGRGVDVVLDSLAGEFVDASLRLLGPGGVFLEMGKTDIRDPGVIAQEYPGVRYRAFDLFEPGRPRMHQYMLDLAGLFDAGVLRPLPVTAFDVRRAPAALRYLSQARHIGKVVMTMPADQGGALGGGTVLITGGTGMAGSALARHLVAHHGVAHLVLISRRGPAAPGATELVAELSAAGAQVEVVACDAADRPALAKVIAEIPAQRPLSAVVHAGGVLDDAVISSLTPERVDTVLRAKVDAAWNLHELTRDLDLSAFVMFSSMAGVVGSSGQANYAAANTFVDGLAAHRRAHGLPAISLGWGLWDQASDMTGGMDAADRARLGREGVLALSSDEAMELFDTALIVNQAFLAPARIDLAALRAHAVAVPPMFSDLVSAPTRRQVDDALAAAKSKSALAHRLHGLPEPEQHAVVLDLVRSHIATVLGTITPEAIDPDKAFQELGFDSLTAVEMRNRIKTVTGLSLSPTLIFDYPTPNGLANYIRAELAGAPQEVKHTPAVRVTGDDPIAIVGMSCRYPGGIESPDDLWDMLMARRDVLSDFPADRGWDLAGLFNPDPDVPGACYTRTGGFVDRVGDFDPAFFGVGPSEALAMDPQQRMFLELSWEALERAGIEPGGLRGSATGVFAGVMTQGYGMFAAEPVEGFRLTGQLSSVASGRVAYVLGLEGPAVSVDTACSSSLVALHMAVQSLRSGECDLALAGGVTINATPDIFVEFSRWRGLSADGRCKAFAGAADGTGFSEGGGMLVVERLSDAQRLGHPVLALVRGSAVNQDGASNGLTAPNGPSQQRVVRAALANAGLSAAEVDVVEGHGTGTTLGDPIEAQALLATYGQDRGSAGAAGKALWLGSIKSNMGHTQAAAGVAGVIKMVQAMRHEVLPATLHVDVPSPHVDWSAGAVELLTEAQPWPAESAGDRVRRAGVSSFGISGTNAHVIVEAAPRVEVGGSSGGAVPVVPWVVSAKSGSALGAQAARLAAHVRSHDELDVADVGWSLAGRSTFEHRAVVLGVDRDGLLAGLDELAGDEFGGASVIRGVAGAAGKTVFVFPGQGSQLLGMGMGLHAGYPVFAEAFNTVVGELDRHLLRPLREVIWGHDENLLNTTEFAQPALFAVEVALYRLLESWGVRPDFVMGHSVGELSAAHVAGVLSLENAAVLVAARGRLMQALPDGGAMIAVQATEQEVLPLLGAQVSIAAINGPASVVISGAQDAVSAVAEQLRADGRRVHRLAVSHAFHSPLMDPMIDEFATVAGELTVNAPTIGIISNLTGQLAGEDFGSAAYWKRHVRDAVRFADSIRFAQSAGAARFLEVGPSSGLTASIEEVLSDAAVTNPVATASALRKDRPEPVSLVSAVAGVFVAGTAVDWRAVVGQSNFVELPTYAFERRRFWLSGDAVAADAAGLGLQAGEHALLGAVVELPASGGVVLTGRLSLAAQGWLADHAVGGVVIFPGAGFVELAIRAGDEVGCRVVDELTLAAPLVLPSGGSVAVQVVVGSPDDSGARAVSVYSRGDAGSDWVLHAEGSLGSGSPEPATDLSTWPPVGAVEVENADGYQQLAERGYGYGPAFRGLNAMWRRGDEVFAEVALPADAGVSVSGFGIHPVMLDAALHAVILASDGADDFGVPEGSVLVPFAWQGVTLHAAGASAVRARIAPAGPSAVSIELSDGLGLPVLSVASMLARPVTDQQLRAAVSGAGPDRLFGVDWTAQPSAELQPVPVRIWGAVESEGDDDPGASVVFESVPQAGEVVAGVYAATAAVLEVLRSWLSRDGAGQLVITTRGAVALPDEDVTDLAGSAVWGLVRSAQTEHPGRIVLVDTDAQLDEHAVAAVLAAGEPQVLWRNGEVYTARVHGSRAVAGLLVPPGDGPWRLGMSTAGTFENLRLEPIPDADAALQPGHVRVALSAMAANFRDVMIALGLYPDPDAAMGVEGAGVVVETASTDGRFAVGDRVVGLFPEGTGTIAITDHRLLVKIPAGWSDTAAATTSVVFATAFYALRDLASVQPGQRILVHAATGGVGMAAVQLARHWGLEVFATASKGKWDTLRAMGFDEDHIGDSRSLEFEDKFRAATGGRGMDVVLDSLAGEFVDASLRLVAPGGVFLEMGKTDIREAAVVAQQHTGVRYRAFDLFEAGPDHIAQILAELAALFSEDALRPLPVTTFDVRRAPAALRYLSQARHVGKVVLTMPDAWAAGTVLITGGTGMAGSALARHVVAHHGVRQLVLVSRRGPDAPGAAELAEELSAFGAQVQVVACDAADRAALAKLIADIPVQHPLSAVIHTAGALDDAVVTSLTPERMETVLRAKVDAAWNLHELTRDMDLSAFVMFSSMAGLVGSSGQGNYAAANSFLDGLAVHRQAHGLPAISLGWGLWDQASNMTGGLAAVDFKRFARDGIVAMSSDEALGLLDTAMVLGEPFMLPAHIDFAALRVKFDGGTLPPMFVDLINAPTRRQVDDSLAAAKSKSALLQRLEGLPEDEQHAILLNLVRSHIATVLGNSSPDAIDPDRAFQELGFDSLTAVEMRNRLKSATGLALSPTLIFDYPNSAALAGYMHRELVGASPQSDITAEAPGEAELQRVVASIPVKRLRQAGVLELLLALANETGGNGQAAVTAETSEEDLADMDLDALVNAAFMNDDE

SEQ ID NO: 69 - protein, 4187 aa, Mycobacterium liflandii
MVDQLQHATEALRKALVQVERLKRTNRALLERSSEPIAIVGMSCRFPGGVDSPEGLWQMVAEGRDVMSDFPTDRGWDLADLFDPDPDTPHKSYASTGGFVDGVADFDPGFFGIAPSEALAMDPQHRMLLELSWEALERSGIDPTGLRGSATGVFAGLIVQGYGMFAEEIEGYRLTGMTSSVASGRVAYVLGLEGPAVSVDTACSSSLVALHMAVQSLRSGECDLALAGGATVNATPTVFVEFSRHRGLAPDGRSKAYAGAADGVGWSEGGAMLVVERLSDAQRLGHPVLALVRGSAVNQDGASNGLTAPNGPSQQRVVRAALANAGLSAAEVDVVEGHGTGTTLGDPIEAQALLATYGQDRGSAGAAGKALWLGSIKSNMGHTQAAAGVAGVIKMVQAMRHEVLPATLHVDVPSPHVDWSAGAVELLTEAQPWPAESAGDRVRRAGVSSFGISGTNAHVIVEAAPRVEVGGSSGGAVPVVPWVVSAKSGSALGAQAARLAAHVRSHDELDVADVGWSLAGRSTFEHRAVVLGVDRDGLLAGLDELAGDEFGGASVIRGVAGAAGKTVFVFPGQGSQWIGMGIELLDTAPVFARHIESCGQAFAEFVDWSLLDVLRGAAGAPGLDRVDVVQPVLFSVMVSLAELWKSVGVRPDAVIGHSQGEIAAAYVAGALSLRDAAKVVTLRSKLLVGLAGPGGMVSVACGEQQARELLEPFGDRVSIAAINGPSAVVVSGEVAALEELIAQCADRELRTRRIDVDYASHSVEVEAIEGQLTEVLAGIEPLSSRTAFFSSVTGSRLDTAELDAEYWYRNIRQTVQFDQAVRSACGHGYRTFIESSPHPALIAGIEDIYRNCAADSGADPIVVPTLGREDGGLQRFLASAAAAFVAGVNVDWRGPLDGAGLVELPTYAFEKRRFWLSGEGVSVDASGLGLSAGGHALLGAVVELPESGGVVLTGRLALGAHGWLADHAVSGVVVFPGTGFVELAIRAGDEVGCSVVNELTLRTPLVLPASGSVAVQVVVGAAADSAERSVSIYSRTDTDAGSVWVCHAEGTLGADSAQPAADLSAWPPAGAIAVDVADGYERLDARGYGYGPAFRGLTAMWARGEELFAEVRLPEAAGSTSGFGVHPALLDAALHTAVIANPDAELVLPFSWQGVSLHAAGAASVRVRIAPVGPSSVSVELADDLGLPVLSVKAMVARPVSEQQMRAVVSASGPDRLFEVVWTPMTVAATDAAPAYELFESVAAEGDPLSGTYQRTHQALAAVQSWLTEHDSGVLVVATRGAMALAGEDVTDLAGAAVWGLVRSAQTENPGRLVLVDSDAAVDAAAVATALAVGEPQVVLRNGQPYTARVHASRAADGILVPPVDGPWRLGLSSAGTFENLQLEPVPNAGAPLGPGQVRVAMRAIAANFRDIMITLGMFTHDALIGGEGAGVVVEIGPEVTEFAVGDAVYGFFPDGSGTLVAGDVRLLLPKPADWSYAEAAAISAVFTTAYYAFVHLANVQPGQRVLVHAATGGVGMAAVQLARHLGLEVYATASKGKWDILRAMGFDEDHISDSRSLEFEEKFREVTGGRGVDVVLDSLAGEFVDASLRLLGPGGVFLEMGKTDIRDPGVIAQEYPGVRYRAFDLFEPGRPRMHQYMLDLAGLFDAGVLRPLPVTAFDVRRAPAALRYLSQARHVGKVVMTMPADQGGALGGGTVLITGGTGMAGSALARHLVAHHGVAHLVLISRRGPAAPGATELVAELSAAGAQVEVVACDAADRPALAKVIAEIPAQRPLSAVVHAGGVLDDAVISSLTPERVDTVLRAKVDAAWNLHELTRDLDLSAFVMFSSMAGVVGSSGQANYAAANTFVDGLAAHRRAHGLPAISLGWGLWDQASDMTGGMDAADRARLGREGVLALSSDEAMELFDTALIVNQAFLAPARIDLAALRAHAVAVPPMFSDLVSAPTRRQVDDALAAAKSKSALAHRLHGLPEPEQHAVVLDLVRSHIATVLGTITPEAIDPDKAFQELGFDSLTAVEMRNRIKTVTGLSLSPTLIFDYPTPNGLANYIRAELAGAPQEVKHTPAVRVTGDDPIAIVGMSCRYPGGIESPDDLWDMLMARRDVLSDFPADRGWDLAGLFNPDPDVPGACYTRTGGFVDRVGDFEPAFFGVGPSEALAMDPQQRMFLELSWEALERAGIEPGGLRGSATGVFAGVMTQGYGMFAAEPVEGFRLTGQLSSVASGRVAYVLGLEGPAVSVDTACSSSLVALHMAVQSLRSGECDLALAGGVTINATPDIFVEFSRWRGLSADGRCKAFAGAADGTGFSEGGGMLVVERLSDAQRLGHPVLALVRGSAVNQDGASNGLTAPNGPSQQRVVRAALANAGLSAAEVDVVEGHGTGTTLGDPIEAQALLATYGQDRGSAGAAGKALWLGSIKSNMGHTQAAAGVAGVIKMVQAMRHEVLPATLHVDVPSPHVDWSAGAVELLTEAQPWPAESAGDRVRRAGVSSFGISGTNAHVIVEAAPRVEVGGSSGGAVPVVPWVVSAKSGSALGAQAARLAAHVRSHDELDVADVGWSLAGRSTFEHRAVVLGADRDGLLAGLDELAGDEFGGASVIRGVAAAAGKTVFVFPGQGSQLLGMGMGLHAGYPVFAEAFNTVVGELDRHLLRPLREVIWGHDENLLNTTEFAQPALFAVEVALYRLLESWGVRPDFVMGHSVGELSAAHVAGVLSLENAAVLVAARGRLMQALPDGGAMIAVQATEQEVLPLLGAQVSIAAINGPASVVISGAQDAVSAVAEQLRADGRRVHRLAVSHAFHSPLMDPMIDEFATVAGELTVNAPTIGIISNLTGQLAGEDFGSAAYWKRHVRDAVRFADSIRFAQSAGAARFLEVGPSSGLTALIEEVLSDAAVTNPVATASALRKDRPEPVSLVSAVAGVFVAGTAVDWRAVVGQSHFVELPTYAFERRRFWLSGDAVAADAAGLGLQAGEHALLGAVVELPASGGVVLTGRLSLAAQGWLADHAVGGVVIFPGAGFVELAIRAGDEVGCRVVDELTLAAPLVLPSGGSVAVQVVVGSPDDSGARAVSVYSRGDAGSDWVLHAEGSLGSGSPEPATDLSTWPPVGAVEVENADGYQQLAERGYGYGPAFRGLNAMWRRGDEVFAEVALPADAGVSVSGFGIHPVMLDAALHAVILASDGADDFGVPEGSVLVPFAWQGVTLHAAGASAVRARIAPAGPSAVSIELSDGLGLPVLSVASMLARPVTDQQLRAAVSGAGPDRLFGVDWTAQPSAELQPVPVRIWGAVESEGDDDPGASVVFESVPQAGEVVAGVYAATAAVLEVLRSWLSRDGVGQLVITTRGAVALPDEDVTDLAGSAVWGLVRSAQTEHPGRIVLVDTDAQLDEHAVAAVLAAGEPQVLWRNGEVYTARVHGSRAVAGLLVPPGDGPWRLGMSTAGTFENLRLETIPDADAALQPGHVRVALSAMAANFRDVMIALGLYPDPDAAMGVEGAGVVVETASPDGRFAVGDRVVGLFPEGTGTIAITDHRLLVKIPAGWSDTAAATTSVVFATAFYALRDLASVQPGQRILVHAATGGVGMAAVQLARHWGLEVFATASKGKWDTLRAMGFDEDHIGDSRSLEFEDKFRAATGGRGMDVVLDSLAGEFVDASLRLVAPGGVFLEMGKTDIREAAVVAQQHTGVRYRAFDLFEAGPDHIAQILAEHAALFSEDVLRPLPVTTFDVRRAPAALRYLSQARHVGKVVLTMPDAWAAGTVLITGGTGMAGSALARHVVAHHGVRQLVLVSRRGPDAPGAAELAEELSAFGAQVQVVACDAADRAALAKLIAEIPVQHPLSAVIHTAGALDDAVVTSLTPERMEMVLRAKVDAAWNLHELTRDMDLSAFVMFSSMAGLVGSSGQGNYAAANSFLDGLAVHRQAHGLPAISLGWGLWDQASNMTGGLAAVDFKRFARDGIVAMSSDEALGLLDTAMVLGEPFMLPAHIDFAALRVKFDGGTLPPMFVDLINAPTRRQVDDSLAAAKSKSALLQRLEGLPEDEQHAILLNLVRSHIATVLGNSSPDAIDPDRAFQELGFDSLTAVEMRNRLKSATGLALSPTLIFDYPNSAALAGYMHRELVGASPQSDTTAEAPGEAELQRVVASIPVKRLRQAGVLELLLALANETGGNGQAAVTAETREEDLADMDLDALVNAAFMNDDE

SEQ ID NO: 70 - protein, 4191 aa, Mycobacterium ulcerans
MVDQLQHATEALRKALVQVERLKRTKRALLERSSEPIAIVGMSCRFPGGVDSPEGLWQMVAEGRDVMSDFPTDRGWDLADLFDPDPDTPHKSYASTGGFVDGVADFDPGFFGIAPSEALAMDPQHRMLLELSWEALERSGIDPTGLRGSATGVFAGLIVQGYGMFAEEIEGYRLTGMTSSVASGRVAYVLGLEGPAVSVDTACSSSLVALHMAVQSLRSGECDLALAGGATVNATPTVFVEFSRHRGLAPDGRSKAYAGAADGVGWSEGGAMLVVERLSDAQRLGHPVLALVRGSAVNQDGASNGLTAPNGPSQQRVVRAALANAGLSAAEVDVVEGHGTGTTLGDPIEAQALLATYGQDRGSAGAAGKALWLGSIKSNMGHTQAAAGVAGVIKMVQAMRHEVLPATLHVDVPSPHVDWSAGAVELLTEAQPWPAESAGDRVRRAGVSSFGISGTNAHVIVEAAPRVEVGGSSGGAVPVVPWVVSAKSGSALGAQAARLAAHVRSHDELDVADVGWSLAGRSTFEHRAVVLGADRDGLLAGLDELAGDEFGGASVIRGVAGAAGKTVFVFPGQGSQWIGMGIELLDTAPVFARHIESCGQAFAEFVDWSLLDVLRGAAGAPGLDRIDVVQPVLFAVMVSLAELWKSVGVRPDAVIGHSQGEIAAAYVAGALSLRDAAKVVTLRSKLLVGLAGPGGMVSVACGEQQARELLEPFGDRVSIAAINGPSAVVVSGEVAALEELIAQCADRELRTRRIDVDYASHSVEVEAIEGQLTEVLAGIEPLSSRTAFFSSVTGSRLDTAELDAEYWYRNIRQTVQFDQAVRSACGHGYRTFIESSPHPALIAGIEDTYRNCAADSGADPIVVPTLGREDGGLQRFLASAAAAFVAGVNVDWRGPLDGAGLVELPTYAFEKRRFWLSGEGVSVDASGLGLSAGGHALLGAVVELPESGGVVLTGRLALGAHGWLADHAVSGVVVFPGTGFVELAIRAVDEVGCSVVNELTLRTPLVLPASGSVAVQVVVGAAADSAERSVSIYSRTDTDTDTDAGSVWVCHAEGTLGADSAQPAADLSAWPPAGAIAVDVADGYERLDARGYGYGPAFRGLTAMWARGEELFAEARLPEAAGSTSGFGVHPALLDAALHTAVIANPDADLVLPFSWQGVSLHAAGAASVRVRIAPVGPSSVSVELADDLGLPVLSVKAMVARPVSEQQMRAVVSASGPDRLFEVVWTPMTVAATDAAPAYELFESIAADGDPLSGTYQRTHQALAAVQSWLTEHDSGVLVVATRGAMALAGEDVTDLAGAAVWGLVRSAQTENPGRLVLVDSDAAVDAAAVATALAVGEPQVVLRNGQPYTARVHASRAADGILVPPVDGPWRLGLSSAGTFENLQLEPVPNAGAPLGPGQVRVAMRAIAANFRDIMITLGMFTHDALIGGEGAGVVVEIGPEVTEFAVGDAVYGFFPDGSGTLVAGDVRLLLPKPADWSYAEAAAISAVFTTAYYAFVHLANVQPGQRVLVHAATGGVGMAAVQLARHLGLEVYATASKGKWDILRAMGFDEDHISDSRSLEFEEKFREVTGGRSVDVVLDSLAGEFVDASLRLLGPGGVFLEMGKTDIRDPGVIAQEYPGVRYRAFDLFEPGRPRMHQYMLDLAGLFDAGVLRPLPVTAFDVRRAPAALRYLSQARHVGKVVMTMPADQGGALGGGTVLITGGTGMAGSALARHLVAHHGVAHLVLISRRGPAAPGATELVAELSAAGAQVEVVACDAADRPALAKVIAENPAQRPLSAVVHAGGVLDDAVISSLTPERVDTVLRAKVDAAWNLHELTRDLDLSAFVMFSSMAGVVGSSGQANYAAANTFVDGLAAHRRAHGLPAISLGWGLWDQASDMTGGMDAADRARLGREGVLALSSDEAMELFDTALIVNQAFLAPARIDLAALRAHAVAVPPMFSDLVSAPTRRQIDAALATAKSKSALAHRLHGLPELEQHAVVLDLVRSHIATVLGTITPEAIDPDKAFQELGFDSLTAVEMRNRIKTVTGLSLSPTLIFDYPTPNGLANYIRAELAGAPQEVKHTPAVRVTGDDPIAIVGMSCRYPGGIESPDDLWDMLMARRDVLSDFPADRGWDLAGLFNPDPDVPGACYTRTGGFVDRVGDFEPAFFGVGPSEALAMDPQQRMFLELSWEALERAGIEPGGLRGSATGVFAGVMTQGYGMFAAEPVEGFRLTGQLSSVASGRVAYVLGLEGPAVSVDTACSSSLVALHMAVQSLRSGECDLALAGGVTINATPDIFVEFSRWRGLSADGRCKAFAGAADGTGFSEGGGMLVVERLSDAQRLGHPVLALVRGSAVNQDGASNGLTAPNGPSQQRVVRAALANAGLSAAEVDVVEGHGTGTTLGDPIEAQALLATYGQDRGSAGAAGKALWLGSIKSNMGHTQAAAGVAGVIKMVQAMRHEVLPATLHVDVPSPHVDWSAGAVELLTEAQPWPAESAGDRVRRAGVSSFGISGTNAHVIVEAAPRVEVGGSSGGAVPVVPWVVSAKSGSALGAQAARLAAHVRSHDELDVADVGWSLAGRSTFEHRAVVLGADRDGLLAGLDELAGDEFGGASVIRGVAGAAGKTVFVFPGQGSQLLGMGMGLHAGYPVFAEAFNTVVGELDRHLLRPLREVIWGHDENLLNTTEFAQPALFAVEVALYRLLESWGVRPDFVMGHSVGELSAAHVAGVLSLENAAVLVAARGRLMQALPDGGAMIAVQATEQEVLPLLGAQVSIATINGPASVVISGAQDAVSAVAEQLRADGRRVHRLAVSHAFHSPLMDPMIDEFATVAGELTVNAPTIGIISNLTGQLAGEDFGSAAYWKRHVRDAVRFADSIRFAQSAGAARFLEVGPSIGLTASIEEVLSDAAVTNPVATASALRKDRPEPVSLVSALAGVFVAGTAVDWRAVVGQSHFVELPTYAFERRRFWLSGDAVPADAAGLGLQAGEHALLGAVVELPASGGVVLTGRLSLAAQGWLADHAVGGVVIFPGAGFVELAIRAGDEVGCRVVDELTLAAPLVLPSGGSVAVQVVVGSPDDSGARAVSVYSRGDAGSDWVLHAEGSLGSGSPEPATDLSTWPPVGAVEVENADGYQQLAERGYGYGPAFRGLNAMWRRGDEVFAEVALPADAGVSVSGFGIHPVMLDAALHAVILASDGADDFGVPEGSVLVPFAWQGVTLHAAGASAVRARIAPAGPSAVSIELSDGLGLPVLSVASMLARPVTDQQLRAAVSGAGPDRLFGVDWTAQPSAELQPVPVRIWGTVESEGDDDPGASVVFESVPQAGEVVAGVYAATAAVLEVLRSWLSRDGAGQLIITTRGAVALPDEDVTDLAGSAVWGLVRSAQTEHPGRIVLVDTDAQLDEHAVAAVLAAGEPQVLWRNGEVYTARVHGSRAVAGLLVPPGDGPWRLGMSTAGTFENLRLEPIPDADAALQPGHVRVALSAMAANFRDVMIALGLYPDPDAAMGVEGAGVVVETASPDGRFAVGDRVVGLFPEGTGTIAITDHRLLVKIPAGWSDTAAATTSVVFATAFYALRDLASVQPGQRILVHAATGGVGMAAVQLARHWGLEVFATASKGKWDTLRAMGFDEDHIGDSRSLEFEDKFRAATGGRGMDVVLDSLAGEFVDASLRLVAPGGVFLEMGKTDIREAAVVAQQHTGVRYRAFDLFEAGPDHIAQILAELAALFSEDVLRPLPVTTFDVRRAPAALRYLSQARHVGKVVLTMPDAWAAGTVLITGGTGMAGSALARHVVAHHGVRQLVLVSRRGPDAPGAAELAEELSAFGAQVQVVACDAADRAALAKLIADIPMQHPLSAVIHTAGALDDAVVTSLTPERIETVLRAKVDAAWNLHELTRDMDLSAFVMFSSMAGLVGSSGQGNYAAANSFLDGLAVHRQAHGLPAISLGWGLWDQASNMTGGLAAVDFKRFARDGIVAMSSDEALGLLDTAMVLGEPFMLPAHIDFAALRVKFDGGTLPPMFVDLINAPTRRQVDDSLAAAKSKSALLQRLEGLPEDEQHAILLNLVRSHIATVLGNSSPDAIDPDRAFQELGFDSLTAVEMRNRLKSATGLALSPTLIFDYPNSAALAGYMHRELVGASPQSDTTAEAPGEAELQRVVASIPVKRLRQAGVLELLLALANETGGNGQAAVTAETSEEDLADMDLDALVNAAFMNDDE

SEQ ID NO: 71 - protein, 4151 aa, Mycobacterium canettii
MVDQLQHATEALRKALVQVERLKRTNRALLERSSEPIAIVGMSCRFPGGVDSPEGLWQMVAEGRDVISGFPTDRGWDLAGLFDPDPDARHKSYARTGGFVDSVADFDPAFFGISPSEALAMDPQQRMLLELSWEALERAGIDPTGLRGSATGVFAGLIVGGYGMLAEEIEGYRLTGMTSSVASGRVAYVLGLEGPAVSVDTACSSSLVALHMAGGSLRSGECDLALAGGVTVNATPTVFVEFSRHRGLAPDGRCKPYGGAADGVGWSEGGGMLVLERLSDARRLGHPVLAVVVGSAVNQDGASNGLTAPNGPSQQRVVRAALANAGLSAAEVDVVEGHGTGTTLGDPIEAQALLATYGQDRGASGEPLWLGSIKSNMGHTQAAAGVAGVIKMVLAMRHELLPATLHVDEPSPHVDWSAGAVELLTAPRAWPAGARMRRAGVSSFGISGTNAHVIIEAVPVVPRREAGSAGPVVPWVVSAKSESALRGQAARLAACVRGDDGLDVADVGWSLAGRSVFEHRAVVVGGDRDRLLAGLDELAGDQLGGLVVRGTATPAGKTVFVFPGQGSQWLGMGIELLDTAPAFAQQIDACAEAFAEFVDWSLVDVLRGAPGAPGLDRVDVVQPVLFAVMVSLAELWKSVAVRPDAVIGHSQGEIAAAYVAGALSLRDAVRVVTLRSKLLAGLAGPGGMVSIACGAEQARDLLAPFGDRVNIAVVNGPSAVVVSGEVAALDELINLSATKDLRTRRIEVDYASHSVEVEAIRGPLAEALSGIEPLSTRTVFFSTVTGNRLDTAGLDADYWYRNVRQTVLFDQAVRSACEQGYRTFIESSPHPALITGVEETFAACTDGDGEAIVVPTLGRGDGGLHRFLLSATSAFVAGVAVDWRGALGGAGYVELPTYAFDKRRFWLSAEGSGADAFGLGLGASEHPLLGAVVDLPTSGGVVLTGRLSPTVQPWLADHAVSDVVLFPGTGFVELAIRAGDEVGCSVVDELTLAAPLLLPATGSVAVQVVVDAGRDSNSRGVSIFSRADAQAGWLLHAEGILRPGSVEPGADLSVWPPAGAVAVDVADGYERLAKRGYRYGPAFRGLTAMWARGEEIFAEVRLPEAAGGVGGFGVHPALLDAALHAVVIAGDPDELALPFAWQGVSLHAAGASAVRARIAPVGPSAVSVELADGLGLPVLSVASMVARPVTERQLLAAVSGLGPDRLFEVIWSRASGVTALGSTPAYQIFESVAADQDPVAGSYVRSHQALAAVQSWLTDHESGVLVVATRGAMALPREDVADLAGAAVWGLVRSAQTEHPGRIVLVDSDAATDDAAIAMALATGEPQVVLRGGQVYTARVRGSRAADAILVPPGDGPWRLGLGSAGTFENLRLEPVPNADAPLGPGQVRVAMRAIAANFRDIMITLGMFTHDALLGGEGAGVVVEVGPGVTEFSVGDSVFGFFPDGSGTLVAGDVRLLLPMPADWSYAEAAAISAVFTTAYYAFIHLADVQPGQRVLVHAAAGGVGMAAVQLARHLGLEVFGTASKGKWDTLRTMGFDDDHISDSRSLEFEDKFRAATGGRGFDVVLDSLAGEFVDASLRLVAPGGVFLEMGKTDIRDPGVIAQQYPGVRYRAFDLFEPGRPRMHQYMLELAELFDAGVLRPLPVTTFDVRRAPAALRYLSQARHTGKVVMLMPGSWAAGTVLITGGTGMAGSAVARHVVARHGVRDLVLVSRRGPDAPGAAELVAELAAAGAQVQVVACDAADRAALAKVIADIPAQHRLSGVIHAAGALDDAVVTSLTPERMQTVLRSKVDAAWHLHELTRDLDVSAFVMFSSMAGLVGSSGQANYAAANSFVDALAAHRRAHGLPAISLGWGLWEKASAMTGGLDAADLARLGREGVLALSTAEALELFDTAMIVDEPFLAPARIDLTALRAHAVAVPPMFADLVSAPTRRQVDDSVAAAKSKSALAHRLHGLPEAEQRAVLLDLVRSHIATVLGNITPEAIDPDKAFQDLGFDSLTAVEMRNRLKSATGLSLSPTLIFDYPTPNRLASYIRAELAGLPQEIKHTPALRATSEDPIAIVGMACRYPGGVKSPDDMWDMLIEGRDVLSEFPGDRGWDLAGLYNPDPDAAGACYTRTGGFVDGVGDFDPAFFGVGPSEALAMDPQQRMLLELSWEALERAGIDPTGLRGSATGVFAGVMTQGYGMFAAEPVEGFRLTGQLSSVASGRVAYVLGLEGPAVSVDTACSSSLVALHMAVGSLRSGECDLALAGGVTVNATPDIFVEFSRWRGLSPDGRCKAFAAAADGTGFSEGGGMLVLERLSDARRLGHPVLAVVVGSAVNQDGASNGLTAPNGPSQQRVVRAALANAGLSAAEVDVVEGHGTGTTLGDPIEAQALLATYGQDRGASGEPLWLGSIKSNMGHTQAAAGVAGVIKMVLAMRHELLPATLHVDEPSPHVDWSAGAVELLTAPRAWPAGARMRRAGVSSFGISGTNAHVIIEAVPVVPRREAGSAGPVVPWVVSAKSESALRGQAARLAACVRGDDGLDVADVGWSLAGRSVFEHRAVVVGGDRDRLLAGLDELAGDQLGGLVVRGTATPAGKTVFVFPGQGSQWLGMGMGLHAGYPVFAEAFNTVVGELDRHLLRPLREVMWGHDENLLNSTEFAQPALFAVEVALFRLLESWGVRPDFVMGHSIGELSAAHVAGVLSLENAAVLVAARGRLMQALPAGGAMVAVQAAEEEVRPLLGAEVDIAAVNGPASVVISGAQDAVAAVADQLRADGRRVHQLAVSHAFHSPLMDPMIDEFEAVAAGIAIGRPTIGIISNVTGQLAGDDFGSAAYWRRHIRQAVRFADSVRFAQAAGGSRFLEVGPSGGLVASIEESLPDVAVTTMSALRKDRPEPATLTNAVAQGFVTGMNLDWRAVVGEAQFVELPTYAFQRRRFWLSGDGVAADAAGLGLAASEHALLGAVIDLPGSGGVVLTGRLSPSVQGWLADHTVAGVTIFPGAGFVELAIRAGDEVGCGVVDELTLAAPLVLPASGSVAVQVVVNGPDESGLRAVSVYSRGDVGTSWVLHAEGALRAGSAEPTADLAMWPPAGAVPVEVADGYQQLAERGYGYGPAFRGLTAMWRRGDEVFAEVALPADAGVSVAGFGVHPVLLDAALHAVVLSAESAERGQGSVLVPFSWQGVSLHAAGASAVRARIAPVGPSAVSIELADGLGLPVLSVASMLARPVTDQQLRAAVSSSGPDRLFEVTWSPQPSAAVEPLPVRAWGTTEDSAAVVFESVPLAGDVVADVYAATSSVLGVLQSWLARDGAGVLVVMTRGAVALPGEDVTDLTGAAVWGLVRSAQTEHPGRIVLVDSDAPLDDSALAAVVTTGEPQVLWRRGEIYTARVHGSRAVGGLLVPPGDRPWRLAMSTAGTFENLRLEPIPDADAPLGPGQVRVALSTIAANFRDVMIALGLYPDPDAVMGVEASGVVIETRSDKGPFAVGDRVMGLFPEGTGTIASTDQRLLVKVPAGWSHTAAASTSVVFATTHYALVDLAAARPGQRVLVHAAAGGVGMAAVQLARHLGLEVFGTASKGKWDTLRTMGFDDDHISDSRSLEFEDKFRAATGGRGFDVVLDSLAGEFVDASLRLVAPGGVFLEMGKTDIRDPGVIAQQYPGVRYRAFDLFEAGPDRIAQILAELATLFDAGVLRPLPVTTFDVRRAPAALRYLSQARHTGKVVMLMPGSWAAGTVLITGGTGMAGSAVARHVVARHGVRDLVLVSRRGPDAPGAAELVAELAAAGAQVQVVACDAADRAALAKVIADIPAQHRLSGVIHAAGALDDAVVTSLTPERMQMVLRSKVDAAWHLHELTRDLDVSAFVMFSSMAGLVGSSGQGNYAAANSFVDALAAHRRAHGLPAISLGWGLWEKASAMTGGLATVDFKRFARDGIVAMSSADALQLFDTAMIVDEPFMLPAHIDLAALKVKFDGGTLPPMFVDLINAPTRRQVDDSLAAAKSKSALLQRLEGLPEDEQHAVLLDLVRSHIATVLGSASPEAIDPDRAFQELGFDSLTAVEMRNRLKSATGLALSPTLIFDYPNSAALAGYMRRELLGSSPQDTPAVAAGEAELQRIVASIPVKRLRQAGVLDLLLALANETETSGQDPALAPTAEQDIAEMDLDDLVNAAFRNDDE

SEQ ID NO: 72 - protein, 580 aa, Mycobacterium tuberculosis
MSVRSLPAALRACARLQPHDPAFTFMDYEQDWDGVAITLTWSQLYRRTLNVAQELSRCGSTGDRVVISAPQGLEYVVAFLGALQAGRIAVPLSVPQGGVTDERSDSVLSDSSPVAILTTSSAVDDVVQHVARRPGESPPSIIEVDLLDLDAPNGYTFKEDEYPSTAYLQYTSGSTRTPAGVVMSHQNVRVNFEQLMSGYFADTDGIPPPNSALVSWLPFYHDMGLVIGICAPILGGYPAVLTSPVSFLQRPARWMHLMASDFHAFSAAPNFAFELAARRTTDDDMAGRDLGNILTILSGSERVQAATIKRFADRFARFNLQERVIRPSYGLAEATVYVATSKPGQPPETVDFDTESLSAGHAKPCAGGGATSLISYMLPRSPIVRIVDSDTCIECPDGTVGEIWVHGDNVANGYWQKPDESERTFGGKIVTPSPGTPEGPWLRTGDSGFVTDGKMFIIGRIKDLLIVYGRNHSPDDIEATIQEITRGRCAAISVPGDRSTEKLVAIIELKKRGDSDQDAMARLGAIKREVTSALSSSHGLSVADLVLVAPGSIPITTSGKVRRGACVEQYRQDQFARLDA

SEQ ID NO: 73 - protein, 578 aa, Mycobacterium tuberculosis
MSDSSVLSLLRERAGLQPDDAAFTYIDYEQDWAGITETLTWSEVFRRTRIVAHEVRRHCTTGDRAVILAPQGLAYIAAFLGSMQAGAIAVPLSVPQIGSHDERVSAVLADASPSVILTTSAVAEAVAEHIHRPNTNNVGPIIEIDSLDLTGNSPSFRVKDLPSAAYLQYTSGSTRAPAGVMISHRNLQANFQQLMSNYFGDRNGVAPPDTTIVSWLPFYHDMGLVLGIIAPILGGYRSELTSPLAFLQRPARWLHSLANGSPSWSAAPNFAFELAVRKTTDADIEGLDLGNVLGITSGAERVHPNTLSRFCNRFAPYNFREDMIRPSYGLAEATLYVASRNSGDKPEVVYFEPDKLSTGSANRCEPKTGTPLLSYGMPTSPTVRIVDPDTCIECPAGTIGEIWVKGDNVAEGYWNKPDETRHTFGAMLVHPSAGTPDGSWLRTGDLGFLSEDEMFIVGRMKDMLIVYGRNHYPEDIESTVQEITGGRVAAISVPVDHTEKLVTVIELKLLGDSAGEAMDELDVIKNNVTAAISRSHGLNVADLVLVPPGSIPTTTSGKIRRAACVEQYRLQQFTRLDG

SEQ ID NO: 74 - protein, 584 aa, Mycobacterium tuberculosis
MVSLSIPSMLRQCVNLHPDGTAFTYIDYERDSEGISESLTWSQVYRRTLNVAAEVRRHAAIGDRAVILAPQGLDYIVAFLGALQAGLIAVPLSAPLGGASDERVDAVVRDAKPNVVLTTSAIMGDVVPRVTPPPGIASPPTVAVDQLDLDSPIRSNIVDDSLQTTAYLQYTSGSTRTPAGVMITYKNILANFQQMISAYFADTGAVPPLDLFIMSWLPFYHDMGLVLGVCAPIIVGCGAVLTSPVAFLQRPARWLQLMAREGQAFSAAPNFAFELTAAKAIDDDLAGLDLGRIKTILCGSERVHPATLKRFVDRFSRFNLREFAIRPAYGLAEATVYVATSQAGQPPEIRYFEPHELSAGQAKPCATGAGTALVSYPLPQSPIVRIVDPNTNTECPPGTIGEIWVHGDNVAGGYWEKPDETERTFGGALVAPSAGTPVGPWLRTGDSGFVSEDKFFIIGRIKDLLIVYGRNHSPDDIEATIQEITRGRCAAIAVPSNGVEKLVAIVELNNRGNLDTERLSFVTREVTSAISTSHGLSVSDLVLVAPGSIPITTSGKVRRAECVKLYRHNEFTRLDAKPLQASDL

SEQ ID NO: 75 - protein, 584 aa, Mycobacterium tuberculosis
MVASSIPTALRERASVHPNGAAITYIDYEQDWAGVAETLTWSQLYRRMLNVAEPLRHVGATGDRAVILAPQGIEYVVGFLGALQAGRIAVPLPVPHAGAHDERTISVLSDTSPAVILTTSGAVDDVRECAQPQPGQSAPSIVELDLLDLDSRQRSRSPGARPTGRDTPETAYLQYTSGSTRTPAGVMVSNKNVFANFEQIVADFFAPEGGVVPPDLTVVSWLPLYHDMGLLLGAIMPILAGVPTVLTSPVGFLQRPARWIQLLARNGRTISAGPNFAFELAVRKTSDDDMDGLDLAGVHTILNGSERVHPATLKRFAERFGRFNFAAAALRPAYGMAEATVYIATRNVNEPPEIVDFESEKLPAGQAIRCPSGSGTPLVSYGVPRSQLVRIVDPDTCIECPQGSVGEIWVQGGNVASGYWHKPEESKRTFGARIVTPSAGTPEAPWLRTGDSGFVSGGELFIIGRIKDLLIVYGRNHAPDDIEATIQEITSGRCAAIAVPDHGTEKLVAIIELKKRGDSDEDVADRLRIVKRDVAAAIFDSHGLSVADLVLVSPGSIPITTSGKIRRAQCVQLYRRREFTRLDA

SEQ ID NO: 76 - protein, 422 aa, Mycobacterium tuberculosis
MFPGSVIRKLSHSEEVFAQYEVFTSMTIQLRGVIDVDALSDAFDALLETHPVLASHLEQSSDGGWNLVADDLLHSGICVIDGTAATNGSPSGNAELRLDQSVSLLHLQLILREGGAELTLYLHHCMADGHHGAVLVDELFSRYTDAVTTGDPGPITPQPTPLSMEAVLAQRGIRKQGLSGAERFMSVMYAYEIPATETPAVLAHPGLPQAVPVTRLWLSKQQTSDLMAFGREHRLSLNAVVAAAILLTEWQLRNTPHVPIPYVYPVDLRFVLAPPVAPTEATNLLGAASYLAEIGPNTDIVDLASDIVATLRADLANGVIQQSGLHFGTAFEGTPPGLPPLVFCTDATSFPTMRTPPGLEIEDIKGQFYCSISVPLDLYSCAVYAGQLIIEHHGHIAEPGKSLEAIRSLLCTVPSEYGWIME

SEQ ID NO: 77 - protein, 472 aa, Mycobacterium tuberculosis
MLRVGPLTIGTLDDWAPSTGSTVSWRPSAVAHTKASQAPISDVPVSYMQAQHIRGYCEQKAKGLDYSRLMVVSCQQPGQCDIRAANYVINAHLRRHDTYRSWFQYNGNGQIIRRTIQDPADIEFVPVHHGELTLPQIREIVQNTPDPLQWGCFRFGIVQGCDHFTFFASVDHVHVDAMIVGVTLMEFHLMYAALVGGHAPLELPPAGSYDDFCRRQHTFSSTLTVESPQVRAWTKFAEGTNGSFPDFPLPLGDPSKPSDADIVTVMMLDEEQTAQFESVCTAAGARFIGGVLACCGLAEHELTGTTTYYGLTPRDTRRTPADAMTQGWFTGLIPITVPIAGSAFGDAARAAQTSFDSGVKLAEVPYDRVVELSSTLTMPRPNFPVVNFLDAGAAPLSVLLTAELTGTNIGVYSDGRYSYQLSIYVIRVEQGTAVAVMFPDNPIARESVARYLATLKSVFQRVAESGQQQNVA

SEQ ID NO: 78 - protein, 511 aa, Mycobacterium tuberculosis
MRIGPVELSAVKDWDPAPGVLVSWHPTPASCAKALAAPVSAVPPSYVQARQIRSFSEQAARGLDHSRLLIASVEVFGHCDLRAMTYVINAHLRRHDTYRSWFELRDTDHIVRHSIADPADIEFVPTTHGEMTSADLRQHIVATPDSLHWDCFSFGVIQRADSFTFYASIDHLHADGQFVGVGLMEFQSMYTALIMGEPPIGLSEAGSYVDFCVRQHEYTSALTVDSPEVRAWIDFAEINNGTFPEFPLPLGDPSVRCGGDLLSMMLMDEQQTQRFESACMAANARFIGGMLACIAIAIHELTGADTYFGITPKDIRTPADLMTQGWFTGQIPVTVPVAGLSFNEIARIAQTSFDTGADLAKVPFERVVELSPSLRRPQPLFSLVNFFDAQVGPLSAVTKLFEGLNVGTYSDGRVTYPLSTMVGRFDETAASVLFPDNPVARESVTAYLRAIRSVCMRIANGGTAERVGNVVALSPGRRNNIERMTWRSCRAGDFIDICNLKVANVTVDREA

SEQ ID NO: 79 - protein, 165 aa, Mycobacterium tuberculosis
MTQLPQPTWRWWQQRETEQVQSSHIDGEIVGALIPDLAVLHSEDASRAAVGREKHRCSLDPLGGGFRSRRASMPAGALLLSAVIAIQLDRMNARVFGDGWIGAQACMWVNKFHEESTVTALSPSSPIAQGSIARHPETMQSAYVRIAEGGSRDVAPAAQLQRRRP

SEQ ID NO: 80 - protein, 628 aa, Escherichia coli
MSFSEFYQRSINEPEQFWAEQARRIDWQTPFTQTLDHSNPPFARWFCEGRTNLCHNAIDRWLEKQPEALALIAVSSETEEERTFTFRQLHDEVNAVASMLRSLGVQRGDRVLVYMPMIAEAHITLLACARIGAIHSVVFGGFASHSVAARIDDAKPVLIVSADAGARGGKIIPYKKLLDDAISQAQHQPRHVLLVDRGLAKMARVSGRDVDFASLRHQHIGARVPVAWLESNETSCILYTSGTTGKPKGVQRDVGGYAVALATSMDTIFGGKAGGVFFCASDIGWVVGHSYIVYAPLLAGMATIVYEGLPTWPDCGVWWKIVEKYQVSRMFSAPTAIRVLKKFPTAEIRKHDLSSLEVLYLAGEPLDEPTASWVSNTLDVPVIDNYWQTESGWPIMAIARGLDDRPTRLGSPGVPMYGYNVQLLNEVTGEPCGVNEKGMLVMEGPLPPGCIQTIWGDDGRFVKTYWSLFSRPVYATFDWGIRDADGYHFILGRTDDVINVAGHRLGTREIEESISSHPGVAEVAVVGVKDALKGQVAVAFVIPKESDSLEDRDVAHSQEKAIMALVDSQIGNFGRPAHVWFVSQLPKTRSGKMLRRTIQAICEGRDPGDLTTIDDPASLDQIRQAMEE

SEQ ID NO: 81 - protein, 590 aa, Streptomyces coelicolor
MRKVLIANRGEIAVRVARACRDAGIASVAVYADPDRDALHVRAADEAFALGGDTPATSYLDIAKVLKAARESGADAIHPGYGFLSENAEFAQAVLDAGLIWIGPPPHAIRDLGDKVAARHIAQRAGAPLVAGTPDPVSGADEVVAFAKEHGLPIAIKAAFGGGGRGLKVARTLEEVPELYDSAVREAVAAFGRGECFVERYLDKPRHVETQCLADTHGNVVVVSTRDCSLQRRHQKLVEEAPAPFLSEAQTEQLYSSSKAILKEAGYVGAGTVEFLVGMDGTISFLEVNTRLQVEHPVTEEVAGIDLVREMFRIADGEELGYDDPALRGHSFEFRINGEDPGRGFLPAPGTVTLFDAPTGPGVRLDAGVESGSVIGPAWDSLLAKLIVTGRTRAEALQRAARALDEFTVEGMATAIPFHRTVVRDPAFAPELTGSTDPFTVHTRWIETEFVNEIKPFTTPADTETDEESGRETVVVEVGGKRLEVSLPSSLGMSLARTGLAAGARPKRRAAKKSGPAASGDTLASPMQGTIVKIAVEEGQEVQEGDLIVVLEAMKMEQPLNAHRSGTIKGLTAEVGASLTSGAAICEIKD

SEQ ID NO: 82 - protein, 590 aa, Streptomyces coelicolor; identical to SEQ ID NO: 81

SEQ ID NO: 83 - protein, 530 aa, Streptomyces coelicolor
MSEPEEQQPDIHTTAGKLADLRRRIEEATHAGSARAVEKQHAKGKLTARERIDLLLDEGSFVELDEFARHRSTNFGLDANRPYGDGVVTGYGTVDGRPVAVFSQDFTVFGGALGEVYGQKIVKVMDFALKTGCPVVGINDSGGARIQEGVASLGAYGEIFRRNTHASGVIPQISLVVGPCAGGAVYSPAITDFTVMVDQTSHMFITGPDVIKTVTGEDVGFEELGGARTHNSTSGVAHHMAGDEKDAVEYVKQLLSYLPSNNLSEPPAFPEEADLAVTDEDAELDTIVPDSANQPYDMHSVIEHVLDDAEFFETQPLFAPNILTGFGRVEGRPVGIVANQPMQFAGCLDITASEKAARFVRTCDAFNVPVLTFVDVPGFLPGVDQEHDGIIRRGAKLIFAYAEATVPLITVITRKAFGGAYDVMGSKHLGADLNLAWPTAQIAVMGAQGAVNILHRRTIADAGDDAEATRARLIQEYEDALLNPYTAAERGYVDAVIMPSDTRRHIVRGLRQLRTKRESLPPKKHGNIPL

SEQ ID NO: 84 - protein, 69 aa, Streptomyces coelicolor
MTIKVVRGNPTPEELAAALTVVRARAVTAAAEPSTTDRPHDAWSDPSRIATHHMPHPGPTAWGRTYWPT

SEQ ID NO: 85 - protein, 485 aa, Streptomyces coelicolor
VSSLFPALSPAPTGAPADRPALRFGERSLTYAELAAAAGATAGRIGGAGRVAVWATPAMETGVAVVAALLAGVAAVPLNPKSGDKELAHILSDSAPSLVLAPPDAELPPALGALERVDVDVRARGAVPEDGADDGDPALVVYTSGTTGPPKGAVIPRRALATTLDALADAWQWTGEDVLVQGLPLFHVHGLVLGILGPLRRGGSVRHLGRFSTEGAARELNDGATMLFGVPTMYHRIAETLPADPELAKALAGARLLVSGSAALPVHDHERIAAATGRRVIERYGMTETLMNTSVRADGEPRAGTVGVPLPGVELRLVEEDGTPIAALDGESVGEIQVRGPNLFTEYLNRPDATAAAFTEDGFFRTGDMAVRDPDGYVRIVGRKATDLIKSGGYKIGAGEIENALLEHPEVREAAVTGEPDPDLGERIVAWIVPADPAAPPALGTLADHVAARLAPHKRPRVVRYLDAVPRNDMGKIMKRALNRD

SEQ ID NO: 86 - protein, 728 aa, Propionibacterium freudenreichii
MSTLPRFDSVDLGNAPVPADAAQRFEELAAKAGTEEAWETAEQIPVGTLFNEDVYKDMDWLDTYAGIPPFVHGPYATMYAFRPWTIRQYAGFSTAKESNAFYRRNLAAGQKGLSVAFDLPTHRGYDSDNPRVAGDVGMAGVAIDSIYDMRELFAGIPLDQMSVSMTMNGAVLPILALYVVTAEEQGVKPEQLAGTIQNDILKEFMVRNTYIYPPQPSMRIISEIFAYTSANMPKWNSISISGYHMQEAGATADIEMAYTLADGVDYIRAGESVGLNVDQFAPRLSFFWGIGMNFFMEVAKLRAARMLWAKLVHQFGPKNPKSMSLRTHSQTSGWSLTAQDVYNNVVRTCIEAMAATQGHTQSLHTNSLDEAIALPTDFSARIARNTQLFLQQESGTTRVIDPWSGSAYVEELTWDLARKAWGHIQEVEKVGGMAKAIEKGIPKMRIEEAAARTQARIDSGRQPLIGVNKYRLEHEPPLDVLKVDNSTVLAEQKAKLVKLRAERDPEKVKAALDKITWAAANPDDKDPDRNLLKLCIDAGRAMATVGEMSDALEKVFGRYTAQIRTISGVYSKEVKNTPEVEEARELVEEFEQAEGRRPRILLAKMGQDGHDRGQKVIATAYADLGFDVDVGPLFQTPEETARQAVEADVHVVGVSSLAGGHLTLVPALRKELDKLGRPDILITVGGVIPEQDFDELRKDGAVEIYTPGTVIPESAISLVKKLRASLDA

SEQ ID NO: 87 - protein, 638 aa, Propionibacterium freudenreichii
MSSTDQGTNPADTDDLTPTTLSLAGDFPKATEEQWEREVEKVFNRGRPPEKQLTFAECLKRLTVHTVDGIDIVPMYRPKDAPKKLGYPGVTPFTRGTTVRNGDMDAWDVRALHEDPDEKFTRKAILEDLERGVTSLLLRVDPDAIAPEHLDEVLSDVLLEMTKVEVFSRYDQGAAAEALMGVYERSDKPAKDLALNLGLDPIGFAALQGTEPDLTVLGDWVRRLAKFSPDSRAVTIDANVYHNAGAGDVAELAWALATGAEYVRALVEQGFNATEAFDTINFRVTATHDQFLTIARLRALREAWARIGEVFGVDEDKRGARQNAITSWRELTREDPYVNILRGSIATFSASVGGAESITTLPFTQALGLPEDDFPLRIARNTGIVLAEEVNIGRVNDPAGGSYYVESLTRTLADAAWKEFQEVEKLGGMSKAVMTEHVTKVLDACNAERAKRLANRKQPITAVSEFPMIGARSIETKPFPTAPARKGLAWHRDSEVFEQLMDRSTSVSERPKVFLACLGTRRDFGGREGFSSPVWHIAGIDTPQVEGGTTAEIVEAFKKSGAQVADLCSSAKIYAQQGLEVAKALKAAGAKALYLSGAFKEFGDDAAEAEKLIDGRLYMGMDVVDTLSSTLDILGVAK

SEQ ID NO: 88 - protein, 148 aa, Propionibacterium freudenreichii
MSNEDLFICIDHVAYACPDADEASKYYQETFGWHELHREENPEQGVVEIMMAPAAKLTEHMTQVQVMAPLNDESTVAKWLAKHNGRAGLHHMAWRVDDIDAVSATLRERGVQLLYDEPKLGTGGNRINFMHPKSGKGVLIELTQYPKN

SEQ ID NO: 89 - protein, 183 aa, Escherichia coli
MADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 90 - protein, 165 aa, Bacillus subtilis subsp. subtilis
MKIYGIYMDRPLSQEENERFMSFISPEKREKCRRFYHKEDAHRTLLGDVLVRSVISRQYQLDKSDIRFSTQEYGKPCIPDLPDAHFNISHSGRWVICAFDSQPIGIDIEKTKPISLEIAKRFFSKTEYSDLLAKDKDEQTDYFYHLWSMKESFIKQGRQRLIASA

SEQ ID NO: 91 - DNA, 25 bp, Unknown
  Synthetic sequence
catatgtttcccggatctgtgatcc

SEQ ID NO: 92 - DNA, 35 bp, Unknown
  Synthetic sequence
ctgcagactagtagatcggcgggctggttgcttag

SEQ ID NO: 93 - DNA, 25 bp, Unknown
  Synthetic sequence
catatgagtgtgcgttcccttcccg

SEQ ID NO: 94 - DNA, 34 bp, Unknown
  Synthetic sequence
ctgcagactagtaattctgtgtagacggccagcc

SEQ ID NO: 95 - DNA, 25 bp, Unknown
  Synthetic sequence
catatgctggcccgtcacggaccac

SEQ ID NO: 96 - DNA, 35 bp, Unknown
  Synthetic sequence
ctgcagactagtggccagctacatccggagcatag

SEQ ID NO: 97 - DNA, 6336 bp, Mycobacterium tuberculosis
atggaatcacgtgtcactcccgttgcggtgatcgggatgggatgtcggcttcctggggggatcaactcgcccgacaaactgtgggagtcgttgctgcgcggtgatgacttggtcaccgagattccgcccgaccgctgggacgccgacgactattacgaccctgagccaggggttcccgggcggtcggtgtcccggtggggtgggttccttgacgacgtcgccggtttcgatgctgagttcttcgggattagcgagcgggaagcgacctcgatcgatccgcagcagcggctactgctggaaacgtcgtgggaggcgatcgagcatgctggtctggatccggcgtcgttggccgggtcctcgacggccgtttttactgggctgacccacgaggactacctggtactcaccacaacggcgggcggtttggccagtccatatgtggttaccggcctcaacaacagtgtggcgtcagggcggatcgcgcacacattgggtctacatggtccggcgatgacgtttgacaccgcgtgttcttcgggtctgatggcggtgcacctggcctgccgcagcctgcatgacggcgaagctgacctcgctttggcgggcggttgtgcggtgctgctggagccgcatgccagtgtggcggcgtctgcgcagggcatgctgtcgtcaaccggtcggtgccattcattcgatgctgacgcggatgggtttgtgcgttccgagggctgcgcgatggtgttgctgaagcgactgccggatgcgctgcgcgacggtaatcggatcttcgccgtggtgcgtggcacggccaccaatcaggacggccgcacggagacgctcaccatgccgtccgaggacgcccaggttgccgtgtaccgtgcggcgttggcggcggcgggcgtgcagcccgaaacggtcggtgtggtcgaggcgcacggcaccggtacgccaatcggcgacccgattgagtaccgcagcctggcgcgggtgtatggcgcgggcaccccctgcgcgcttggatcggccaagagcaacatggggcacagcacggcatcggcggggaccgtcgggctgatcaaggcaattctgtcactgcggcacggggtggtgccgccgctgctgcatttcaatcggctgcccgatgagctttccgacgtcgagaccgggctctttgtgccgcaagcggttacgccgtggcccaacggtaatgatcacacaccgaagcgggtcgcggtgtcctcgttcgggatgtccgggaccaacgtgcatgccatcgtggaagaggccccagcagaagcttccgcacccgagagttcaccgggcgacgctgaggtgggcccgcggctattcatgctgtcgtccacgtccagcgacgcactgcgccagacggcccgccaactagccacctgggtggaagaacaccaggactgcgtggcggcctcggatctggcctacacgctggcgcgtggccgcgcgcaccggccggtgcgcaccgcggtggttgccgccaacctgccggagctcgtcgagggtttgcgcgaggtggccgacggtgacgccctctatgacgcggcggtgggacacggtgatcgaggaccggtctgggtcttctccgggcaagggtcgcagtgggcggcgatgggcacgcaattgctcgccagcgaaccagtgttcgcggccaccatcgccaagctggagccggtgatcgccgcagaatcgggattctcggtgaccgaggcgataacggcgcagcagaccgtgaccggaatcgacaaagtgcagccggcagtgttcgccgttcaggtcgcgttggccgccaccatggagcaaacctacggagtgcggccgggcgcggtcgtcggacactcgatgggtgagtcggccgcggccgtcgtcgcgggggcactgtcgctcgaggacgcggcgcgcgtcatttgccgccgctcgaagctgatgacccgcatagccggtgctggtgccatgggctcggtggaattgcccgccaagcaagtgaattcggagctgatggcacgcggaatcgacgatgttgtggtctcggtggtggcgtccccgcaatccacggtgatcggcggtacgagcgacaccgttcgtgacctcatcgcccgttgggagcagcgggacgtgatggcgcgcgaggtggccgtcgacgtggcgtcgcactcgcctcaagtcgatccgatactcgacgatttggccgcggcgctggcggacattgctccgatgacgcccaaggtgccgtactactcggcgaccctgttcgacccgcgcgagcagccggtgtgcgatggcgcttactgggtggacaatctgcgcaacacggtgcagttcgccgcggcggtgcaggctgcgatggaggacggctaccgggtcttcgcggagctgtcgccccacccgctgcttacccacgccgtcgaacagacgggccgaagcctcgacatgtcggtcgccgccctggccggcatgcggcgagagcagcctctgccgcatggtctgcgcggcttgctgacggagctgcaccgcgcgggcgccgctttggactattcggcgctgtatcccgctgggcggctggtggatgcgccgctgccggcgtggacccacgcccgcctattcatcgacgatgatgggcaagaacagcgggcacaaggtgcctgcaccatcaccgtgcatccgttgcttggctcgcatgtgcggctgactgaggaacctgagcgccacgtctggcagggcgacgttggcacctcggtgctgtcctggctcagcgatcatcaggtgcataacgttgccgcccttcccggcgccgcctactgcgagatggctttggctgcggccgctgaggtcttcggcgaagcggctgaggttcgcgacatcacctttgagcagatgttgttgctcgacgagcagaccccgatcgacgccgtcgcatcgatcgacgcgcctggtgtcgtcaacttcaccgtggagaccaaccgggacggtgaaaccacccggcatgccaccgcggcgctgcgcgccgccgaagatgactgcccgccgccggggtacgacatcaccgctctgctgcaggcgcatccgcacgccgtgaacgggaccgccatgcgggaatcgttcgccgagcgtggtgttactttgggcgccgcgttcggtggtctgaccaccgcgcataccgccgaggcgggagccgcgacggtgctggccgaggtcgcgctgcccgcgtcgatccggttccagcagggcgcctaccgaatccacccggcgctgctggacgcttgtttccagtcggtcggcgcgggcgtccaggccggtacggccactggtggcctgctgttgccgttgggtgtgcgcagcctgcgtgcctacgggcctacccgcaatgcccgctactgctacacgcggttgaccaaggccttcaacgacgggacccgaggtggtgaggccgacctcgacgtgctggacgagcacgggaccgtcctgttggccgtgcgtgggctacgcatgggaaccgggacctccgaacgcgacgagcgtgaccgcctagtcagcgagcggctactgaccctcggatggcagcagcgagcgctgcccgaggttggcgacggcgaggctggatcgtggctattgatcgacacttccaacgccgtcgacacccccgacatgttggcttccacgttgacggacgcgctgaagtcccacggcccccaaggcaccgaatgcgccagcctgtcctggtcggtccaggacaccccgcccaacgatcaagctggcctcgaaaagctgggcagccagctgcgtggccgcgatggtgtggtgatcgtgtatgggcctcgcgtcggcgaccccgatgagcacagtctgctggccggtcgtgaacaggtccgtcacctggttcggatcacccgggaactggctgaattcgagggcgagctgccgcgcttgttcgtggtgaccagacaagcccagatagtgaagccgcacgactcgggagaaagagccaacctggagcaggccggcctgcgtggtctgctacgggtgatcagcagtgaacatccgatgctgcgcaccaccttgatcgatgtggacgaacacacggacgttgagcgggtggcccagcagctgctgagcggatcggaagaggacgagacggcctggcggaatggcgactggtatgtggcccgcttgacccccagtccgctgggccatgaagagcggcgcaccgcggtcttggatcccgaccacgacggtatgcgggtgcaggtccgcaggccgggagacttgcaaacgttggaattcgttgcgagtgaccgagttccgcccggccccgggcaaatcgaagtcgcggtcagcatgtccagcatcaacttcgccgacgttttgatcgcgtttggacgattccccattatcgatgaccgcgagccgcagttgggtatggatttcgtcggtgtggtgactgcggtcggggaaggtgtcaccggtcaccaggtcggtgatcgtgttggcggtttctccgaaggtggctgttggcggacgttcctcacctgtgacgccaacctcgcggtcacgctgccgcccggcttgaccgatgagcaggcgatcacggcggccaccgcgcatgccaccgcctggtatgggctcaacgacctggctcagatcaaggccggtgacaaagtgttgattcactccgccaccggcggtgtggggcaggcggccatatcgattgcccgcgccaagggagcggagattttcgcgaccgccggcaatcccgcgaagcgagccatgctgcgcgacatgggcgtcgagcatgtctacgattcgcgcagcgtcgagttcgccgagcagatccggcgcgacaccgacgggtacggcgtggatatcgtgctgaactcgctgaccggcgccgcccaacgtgcggggctggagttgttggccttcggcggacgcttcgtcgaaatcggcaaggccgacgtttacggcaacacccggctggggctgttcccgttccgtcgcggactgaccttctactacttggacctcgcgctgatgtcggtcacccagcccgaccgggtccgtgagttgctggccacggtgttcaagctcaccgcagacggggtgctgaccgcaccgcaatgcactcattacccgttggccgaggcggccgacgccatccgggcaatgagcaacgccgagcacaccggcaaactcgtgctcgacgtaccgcgtagcggccgtagaagcgtggcggtcaccccggagcaagctccgctgtaccgccgcgacggctcctacatcatcaccggcggcctgggtggcctcggcctgttcttcgcctcgaagctggccgcggcgggctgtggccggatcgtgctgaccgcacgttcccagcccaaccccaaagcgcggcagaccatcgaaggcctgcgcgcggctggggccgacatcgtggtggagtgtggcaacatcgccgaacccgacacggcggaccggctggtgagtgcggcgaccgctaccgggcttccgctgcgcggtgtgctgcactcggcggcggtggtcgaggatgccacgctgaccaacatcaccgatgagctcatcgatcgcgactggtcgcccaaggtgttcggatcctggaacctacaccgcgccaccctcggtcagccgctggactggttctgcttgttctcctcgggagcggcattgctcggctcgccgggtcagggcgcctacgcggcggccaacagctgggtcgacgtcttcgcgcactggcgccgcgcccagggcctgccggtcagcgcgattgcgtggggtgcgtggggcgaggtcggccgcgccacgttcttggccgaggggggcgaaatcatgatcaccccggaggaaggtgcgtatgccttcgagacgctcgtgcgccacgaccgcgcctacagcggttacattccgatcctcggggcgccatggctggccgaccttgtccgacgcagcccgtggggtgaaatgttcgcatccactgggcagcggtcaaggggcccaagcaaattccgcatggagctcctttcgctgccgcaagatgaatgggccggccggctacggcgtctgctggttgagcaggccagtgtgatcctgcgtcgcacgatcgacgctgaccgctcattcatcgagtacggcctggattcgctgggcatgctcgagatgcgtacccacgttgaaaccgagaccgggatacgcctgacccccaaggtcatcgccacaaacaacaccgcccgcgctttggcccagtacttggcggacacgctggccgaggagcaggcggcggcaccggcggcatcatag

SEQ ID NO: 98 - DNA, 1269 bp, Mycobacterium tuberculosis
atgtttcccggatctgtgatccgaaagctgtcgcacagcgaggaagtcttcgcgcagtacgaggtttttacttccatgacaatccagctgcgcggtgttatcgatgtcgatgcgctgtcggatgccttcgacgccctcttggaaacccacccagtcctggccagccaccttgagcaaagctccgacggcggttggaatctcgttgccgacgacctgctgcactctggaatctgtgtcatcgacggcacggccgccaccaacgggtcaccgtcgggaaacgccgaactacggctcgaccagagcgtgtccctattgcatctgcagctgatcctccgcgaaggaggagccgagctgacgctatacctccatcactgcatggccgatggtcatcacggggccgttctcgtcgacgagctgttctcccgctacaccgacgcggtcactaccggtgaccccggcccgataaccccgcagcccacgccgctgtcaatggaggctgtgctggcacagcggggtatcaggaagcaagggctttcgggagctgaacgttttatgtcggtgatgtatgcctatgagatccctgccaccgagacgccggcggtcctcgcgcatcctgggctgccccaagctgttccggtcacccgactctggctttccaagcagcagacatcggacctcatggcgttcggccgcgagcatcgcctcagccttaacgccgtggtcgcggcagccatcctgctgaccgagtggcagctgcgcaacaccccgcacgtcccgattccctacgtttaccccgtcgacctgcgatttgttctagctcccccagtggccccgacagaagctaccaatctcctcggggcggcgtcttacctcgctgagatcgggccgaataccgacatcgtggatctggcaagcgatatcgttgccacacttcgggctgacttggccaatggtgtgattcagcagtcggggctccacttcggcacggcattcgaaggaactcctcccggcctaccaccacttgtcttctgcactgacgccacttcatttcccaccatgcgcacaccgccgggcctggagatcgaagacattaagggccaattctattgttcgatcagcgtccccctcgatctgtactcgtgtgccgtttacgcaggacaactgatcatcgagcatcatgggcacatcgcggaaccggggaagtccctcgaggcgatacgttcactgctgtgcaccgttccctcggagtatggctggatcatggagtga

SEQ ID NO: 99 - DNA, 1743 bp, Mycobacterium tuberculosis
atgagtgtgcgttcccttcccgctgcgttgcgcgcgtgtgcgcgtctgcaaccccatgacccggccttcacgtttatggattacgaacaggactgggacggcgttgcgataaccctgacgtggtcgcagctgtatcggcgaacgctgaatgtggcacaggagctgagccgttgtggttccacgggtgaccgcgtggtgatctctgctccgcagggactcgagtacgtcgtcgcctttctcggcgcgttgcaggccgggcgcatcgccgtgccgctttcggttccacaaggcggcgttaccgatgaacgttccgattcggtactgagtgattcgtcgccggtggccattctcactacatcgtctgccgtggacgacgtcgtgcaacatgttgcgcggcggcccggggaatccccgccatcaattatcgaagttgatttgctcgatctggacgctccgaatgggtataccttcaaagaagacgagtatccatctaccgcgtatttgcaatacacctccgggtccacccgcacgcccgctggcgtggtgatgtcccatcagaacgttcgggttaatttcgaacagctgatgtctggctactttgcggataccgacgggattccaccgccaaattccgcactcgtatcctggctacccttctaccacgacatgggtttggtaataggaatttgcgcaccaattctgggtggataccccgcggtgctcaccagcccggtgtcgttcctgcagcgcccggcccggtggatgcacttgatggccagcgattttcacgccttttcggcagcaccgaatttcgcctttgaactagcggcacgaagaacaaccgacgacgacatggccgggcgtgacctcggcaacatactgaccatcctcagcggtagcgagcgggtacaggccgcgacgatcaagcgcttcgccgaccgctttgctcgcttcaatctgcaggagagggtgatccggccttcatacgggctcgcagaagcaacggtgtacgtggcgacgagcaaaccgggtcaaccaccggagaccgtcgacttcgatactgaaagtttatccgccggccatgcgaagccgtgcgcaggcggcggcgctacatcgttgatcagctacatgttgccgcggtcaccgatcgtgcggatcgtcgactcggacacctgcatcgaatgtccggacggaaccgtcggcgagatctgggtgcacggcgacaacgtcgctaatggctattggcaaaaacccgacgagagtgagcgcacgttcggcggaaagattgtcaccccttcgccgggcacacccgaaggtccttggctaagaacgggcgactcaggtttcgtcaccgatggcaaaatgttcatcatcggtcggatcaaagatctcctaattgtgtacggacgcaaccactcccccgacgacatcgaggcaacgatccaggagatcacccgcgggcgctgcgcggcgatctcggttcccggtgaccgcagcaccgaaaagctggtcgccattatcgaactcaagaagcgtggcgactcagatcaggacgcgatggctagactgggcgctattaaacgcgaagtcacgtcggctttatcgagttcgcacggtctcagcgtcgcggatctggttctggttgcgcctggctcgatccccattaccaccagcgggaaggtcaggagaggggcgtgtgtcgagcaatatcgacaggatcaattcgcccgcttggatgcctag

SEQ ID NO: 100 - DNA, 785 bp, Mycobacterium tuberculosis
atgctggcccgtcacggaccacgctatggtggctcggtgaacgggcactcagacgacagtagcggcgacgcgaagcaagccgcacccacgctgtatattttcccgcatgccggcggcaccgcgaaagactatgtcgcattttcccgagaattttccgccgacgtaaagcggattgctgtccaataccccggccagcacgatcgttctggcctgccaccgcttgagagtattcccaccctcgctgacgaaatctttgcaatgatgaaaccgtcggctcggatcgacgatccggtggcattctttgggcacagtatgggcggaatgctagccttcgaagtagcgttgcgataccaatcggcgggccatcgagtcctggcattctttgtgtcggcctgctcagcaccgggtcatatcagatacaagcagctccaagatttatcagatcgcgagatgttggacttgttcacccgaatgacaggaatgaatccagatttctttaccgacgacgaatttttcgttggagcgctacccacgttgcgagcggtccgagccatcgccggttattcctgcccaccagagacgaagctctcgtgtccgatttatgcctttatcggagataaagattggatcgcaacgcaagacgacatggatccgtggcgcgatcggacgacggaagagttctctatccgtgtattccctggggatcacttctacctcaacgacaatttgccagagctagtcagcgacatagaagacaaaacactccaatggcatgatcgagctta

---

What is claimed is:

1. An engineered microorganism comprising a multi-methyl branched fatty acid (MMBFA) ester synthesis pathway comprising:
   (i) an exogenous or overexpressed mycocerosic acid synthase (MAS) or active fragment thereof comprising an ACP domain;
   (ii) an exogenous or overexpressed long chain fatty acid AMP ligase; and
   (iii) an exogenous or overexpressed ester synthase, wherein the MAS catalyzes the iterative conversion of methyl-malonyl-CoA to MMBFA, and the ester synthase catalyzes the transesterification of MMBFA covalently bound to the ACP domain of MAS with an acceptor alcohol to produce an MMBFA ester,
   wherein said engineered microorganism further comprises:
   (iv) an exogenous or overexpressed propionyl-CoA carboxylase (PCC) complex comprising an amino acid sequence having at least 80% sequence identity to SEQ ID NO: 81, an amino acid sequence having at least 80% sequence identity to SEQ ID NO: 83, and an amino acid sequence having at least 80% sequence identity to SEQ ID NO: 84; and/or (v) an exogenous or overexpressed acyl-acyl carrier protein (ACP) thioesterase comprising an amino acid sequence having at least 80% sequence identity to SEQ ID NO: 89.

2. The engineered microorganism according to claim 1, wherein the MAS or active fragment thereof comprises an acyl transferase (AT) domain, an acyl carrier protein (ACP) domain, and a ketide synthase (KS) domain.

3. The engineered microorganism according to claim 1, wherein the MAS or active fragment thereof comprises SEQ ID NO: 3, or a homolog, fragment, or variant thereof.

4. The engineered microorganism according to claim 1, wherein the long chain fatty acid AMP ligase is a FADD28.

5. The engineered microorganism according to claim 4, wherein the FADD28 comprises SEQ ID NO:72, or a homolog, active fragment, or variant thereof.

6. The engineered microorganism according to claim 1, wherein the ester synthase is a PAPA5.

7. The engineered microorganism according to claim 6, wherein the PAPA5 ester synthase comprises SEQ ID NO:76, or a homolog, active fragment, or variant thereof.

8. The engineered microorganism according to claim 1, wherein the MMBFA synthesis pathway further comprises the following conversions:
(vi) propionate to propionyl-CoA, wherein the enzyme that catalyzes the conversion is a propionyl-CoA synthetase comprising an amino acid sequence having at least 80% sequence identity to SEQ ID NO:80;
(vii) transfer of 4'-phosphopantetheine (4'-PP) moiety from CoA to ACP, wherein the enzyme that catalyzes conversion is an exogenous or overexpressed phosphopantetheinyl transferase comprising an amino acid sequence having at least 80% sequence identity to SEQ ID NO:90; or
(viii) a combination thereof.

9. The engineered microorganism according to claim 1 comprising:
(i) a MAS from *Mycobacterium tuberculosis* (SEQ ID NO:3);
(ii) a FADD28 long chain fatty acid AMP ligase from *Mycobacterium tuberculosis* (SEQ ID NO:72);
(iii) a TESA' thioesterase from *Escherichia coli* (SEQ ID NO:89);
(iv) a propionyl-CoA carboxylase (PCC) complex comprising the ACCA1 (SEQ ID NO:81), PCCB (SEQ ID NO:83), and PCCE (SEQ ID NO:84) subunits from PCC from *Streptomyces coelicolor*; and,
(v) a PAPA5 ester synthase from *Mycobacterium tuberculosis* (SEQ ID NO:76),
wherein the MAS catalyzes the iterative conversion of methyl-malonyl-CoA to MMBFA, and
wherein the ester synthase catalyzes the transesterification of an MMBFA with an acceptor alcohol to produce an MMBFA ester.

10. The engineered microorganism according to claim 1, wherein said microorganism is selected from the group consisting of bacteria, fungi, yeast, and algae.

11. The engineered microorganism according to claim 1, wherein the MMBFA comprises
(i) a fatty acid chain length of about 10 to about 40 carbons, and at least one branching at an even position carbon;
(ii) one to four methyl branches located at carbons 2, 4, 6, or 8 of the fatty acid chain; or,
(iii) a combination thereof.

12. The engineered microorganism according to claim 1, wherein the acceptor alcohol is ethanol, 1-butanol, 1-pentanol, 2-propanol, 2-butanol, 1-octanol, (+/−) 2-octanol, (R)-(−)-2-octanol, 1-nonanol, 1-decanol, (+/−) 2-undecanol, myristyl alcohol (1-tetradecanol), palmityl alcohol (1-hexadecanol), stearyl alcohol (1-octadecanol), 1-eicosanol, trans-2-octene-1-ol, DL-3-OH-methyl palmitate, (S)-(−)-1,2-decanediol, (R)-1,2-decanediol, (+/−) 1,2-octanediol, trimethylpropane, pentaerythrite, neopentylclycol, or a combination thereof.

13. The engineered microorganism according to claim 1, wherein the MMBFA ester product has an ester chain length of about 2 to about 24 carbons.

14. The engineered microorganism according to claim 1, wherein the MMBFA ester product comprises (i) octyl 2,4,6,8-tetramethyltetracosanoate; (ii) (Z)-octyl 2,4,6,8-tetramethylhexacos-17-enoate; (iii) (Z)-octyl 2,4,6,8-tetramethyltetracos-17-enoate; (iv) octyl 2,4,6,8-tetramethyltriacontonoate; (v) ethyl 2,4,6,8-tetramethyltetracosanoate; (vi) (Z)-ethyl 2,4,6,8-tetramethylhexacos-17-enoate; (vii) (Z)-ethyl 2,4,6,8-tetramethyltetracos-17-enoate; (viii) ethyl 2,4,6,8-tetramethyltriacontanoate; (ix) pentyl 2,4,6,8-tetramethyltetracosanoate; (x) (Z)-pentyl 2,4,6,8-tetramethylhexacos-17-enoate; (xi) (Z)-pentyl 2,4,6,8-tetramethyltetracos-17-enoate; (xii) pentyl 2,4,6,8-tetramethyltriacontonoate; (xiii) butyl 2,4,6,8-tetramethyltetracosanoate; (xiv) (Z)-butyl 2,4,6,8-tetramethylhexacos-17-enoate; (xv) (Z)-butyl 2,4,6,8-tetramethyltetracos-17-enoate; (xvi) butyl 2,4,6,8-tetramethyltriacontonoate; (xvii) and combinations thereof.

15. The engineered microorganism according to claim 1, wherein at least one gene encoding one of the exogenous or overexpressed enzymes has been subjected to molecular evolution or mutated to enhance the enzymatic activity of the enzyme.

* * * * *